US011459397B2

(12) United States Patent
Dumitru et al.

(10) Patent No.: US 11,459,397 B2
(45) Date of Patent: Oct. 4, 2022

(54) SELF-CROSSLINKING ANTIBODIES

(71) Applicant: Meditope Biosciences, Inc., Pasadena, CA (US)

(72) Inventors: Calin Dumitru, Pasadena, CA (US); Elisabeth M. Gardiner, Pasadena, CA (US); Robert P. Mckenzie, Pasadena, CA (US); Michael H. Matho, Pasadena, CA (US)

(73) Assignee: Meditope Biosciences Inc., Pasadena, CA (US)

( * ) Notice: Subject to any disclaimer, the term of this patent is extended or adjusted under 35 U.S.C. 154(b) by 0 days.

(21) Appl. No.: 16/068,892

(22) PCT Filed: Jan. 9, 2017

(86) PCT No.: PCT/US2017/012754
§ 371 (c)(1),
(2) Date: Jul. 9, 2018

(87) PCT Pub. No.: WO2017/120599
PCT Pub. Date: Jul. 13, 2017

(65) Prior Publication Data
US 2019/0016822 A1 Jan. 17, 2019

Related U.S. Application Data

(60) Provisional application No. 62/317,342, filed on Apr. 1, 2016, provisional application No. 62/276,803, filed on Jan. 8, 2016.

(51) Int. Cl.
*C07K 16/32* (2006.01)
*C07K 16/00* (2006.01)
*C07K 7/00* (2006.01)
*C07K 16/28* (2006.01)
*C07K 16/30* (2006.01)
*A61P 35/00* (2006.01)

(52) U.S. Cl.
CPC .............. *C07K 16/32* (2013.01); *A61P 35/00* (2018.01); *C07K 7/00* (2013.01); *C07K 16/00* (2013.01); *C07K 16/2803* (2013.01); *C07K 16/2863* (2013.01); *C07K 16/30* (2013.01); *C07K 2317/24* (2013.01); *C07K 2317/52* (2013.01); *C07K 2317/55* (2013.01); *C07K 2317/567* (2013.01); *C07K 2317/76* (2013.01); *C07K 2317/77* (2013.01); *C07K 2317/92* (2013.01); *C07K 2319/00* (2013.01); *C07K 2319/30* (2013.01)

(58) Field of Classification Search
CPC ............ C07K 2317/90; C07K 2319/30; C07K 2319/70

USPC ..................................... 424/133.1; 530/387.3
See application file for complete search history.

(56) References Cited

U.S. PATENT DOCUMENTS

| | | | | |
|---|---|---|---|---|
| 8,658,774 | B2* | 2/2014 | Williams | C07K 16/2863 530/413 |
| 8,962,804 | B2* | 2/2015 | Williams | C07K 16/2863 530/387.1 |
| 9,428,553 | B2* | 8/2016 | Williams | C07K 14/001 |
| 9,574,014 | B2* | 2/2017 | Williams | C07K 14/70575 |
| 9,669,108 | B2* | 6/2017 | Williams | C07K 16/2863 |
| 2009/0221477 | A1 | 9/2009 | Artymiuk et al. | |
| 2012/0177568 | A1* | 7/2012 | Williams | A61K 47/6897 424/1.49 |
| 2012/0301400 | A1* | 11/2012 | Williams | C07K 16/2863 424/9.1 |
| 2014/0113348 | A1* | 4/2014 | Williams | C07K 14/001 435/188 |
| 2015/0030535 | A1* | 1/2015 | Williams | C07K 16/2863 424/1.49 |
| 2016/0333114 | A1* | 11/2016 | Williams | C07K 14/70575 |
| 2017/0226223 | A1* | 8/2017 | Williams | C07K 14/70575 |
| 2018/0148514 | A1* | 5/2018 | Williams | C07K 16/00 |
| 2018/0193479 | A1* | 7/2018 | Williams | C07K 16/2863 |
| 2019/0111149 | A1* | 4/2019 | Gardiner | A61K 47/6849 |

OTHER PUBLICATIONS

Bzymek et al. (Acta Cryst. (2016). F72, 434-442).*
Van Rosmalen et al. (The Journal of Biological Chemistry vol. 292, No. 4, pp. 1477-1489, Jan. 27, 2017).*
Zer et al (Protein Engineering, Design & Selection, 2017, vol. 30 No. 6, pp. 409-417).*
Bzymek et al. (Acta Cryst. (2017). F73, 688-694).*
Van Rosmalen (Anal. Chem. 2018, 90, 3592-3599).*
City of Hope, WO 2013/055404 A1, Apr. 18, 2013—Exhibit 2.
Avery et al., "Development of a high affinity, non-covalent biologic to add functionality to Fabs," Sci Rep, Jan. 15, 2015, vol. 5, pp. 1-5—Exhibit 3.
Donaldson et al., "Identification and grafting of a unique peptide-binding site in the Fab framework of monoclonal antibodies," Proc Natl Acad Sci USA, Oct. 7, 2013, vol. 110, pp. 17456-17461—Exhibit 4.
International Search Report of PCT/US2017/012754—Exhibit 5.
City of Hope, WO 2016/054603 A2, Apr. 7, 2016—Exhibit 1.

* cited by examiner

*Primary Examiner* — Lynn A Bristol
(74) *Attorney, Agent, or Firm* — Adriano & Associates

(57) ABSTRACT

Provided are self-crosslinking meditope-enabled antibodies. Also provided are methods for altering the distribution of a cell surface antigen using self-crosslinking meditope enabled antibodies, compositions for use in the methods, and methods of producing, using, testing, and screening the same, including therapeutic and diagnostic methods and uses.

3 Claims, 14 Drawing Sheets

Specification includes a Sequence Listing.

Modified Arg8

R = alkyl, substituted alkyl, aromatic or NHR'''
where R''' = alkyl, substituted alkyl, aromatic

Fig. 7A
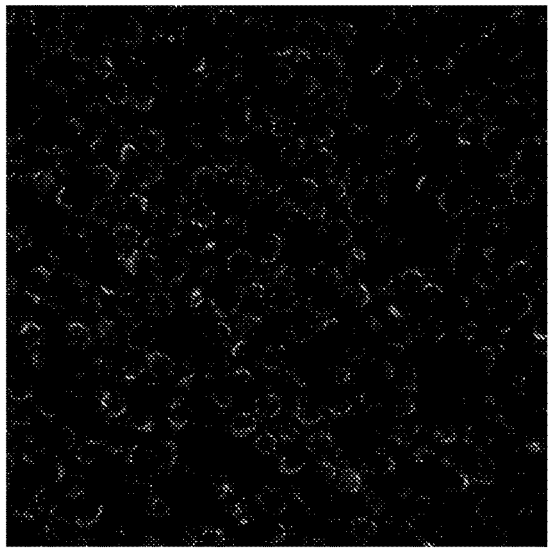
Control Antibody
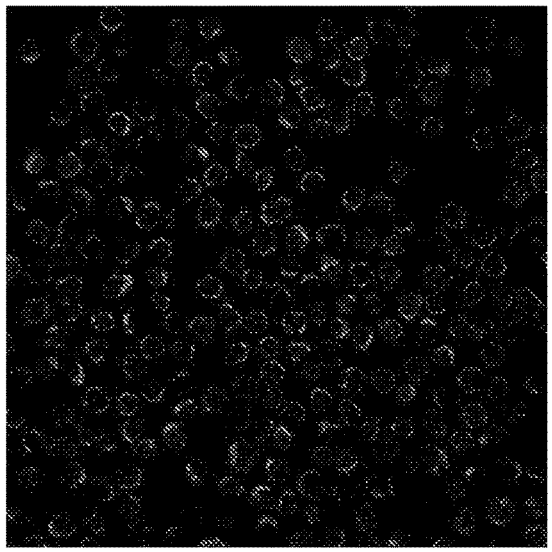
SnAP-body Variant 1
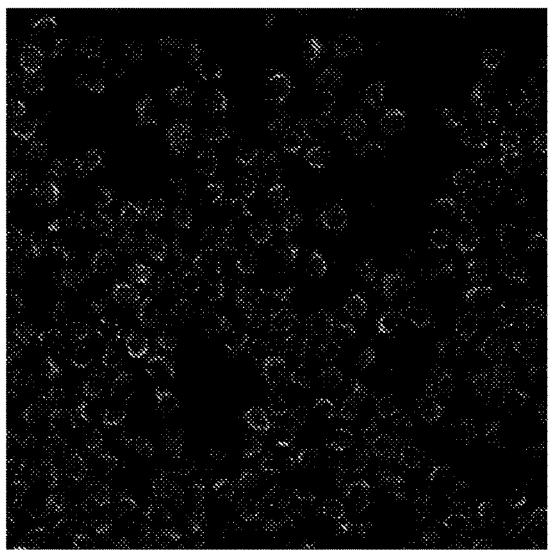
SnAP-body Variant 2

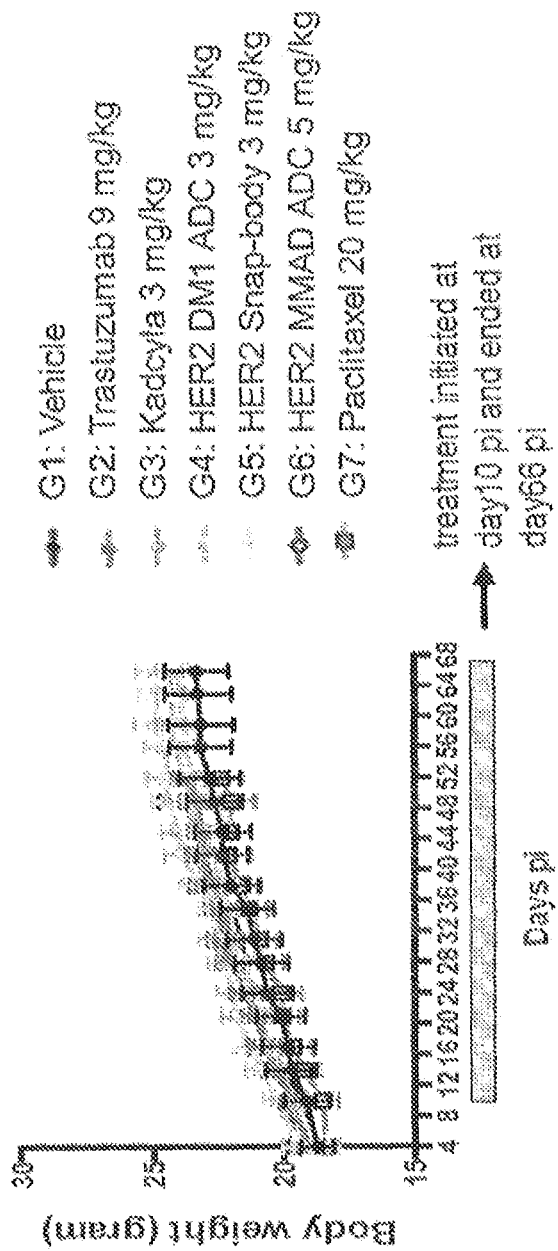

SELF-CROSSLINKING ANTIBODIES

CROSS REFERENCE TO RELATED APPLICATIONS

This subject application claims priority under 35 U.S.C. § 371 to PCT Application No. PCT/US2017/012754, filed Jan. 9, 2017, which claims the benefit under 35 U.S.C. § 119(e) to U.S. Provisional Application No. 62/276,803, filed Jan. 8, 2016, and to U.S. Provisional Application No. 62/317,342, filed Apr. 1, 2016. The contents of these applications are incorporated by reference in their entireties herein.

INCORPORATION BY REFERENCE OF SEQUENCE LISTING

The present application is being filed along with a Sequence Listing in electronic format. The Sequence Listing is provided as a file entitled 49JV_227262_WO_SEQ.txt, created Jan. 9, 2017, which is 601 kilobytes in size. The information in the electronic format of the Sequence Listing is incorporated by reference in its entirety.

BACKGROUND

Monoclonal antibodies (mAbs) are used in a number of therapeutic, diagnostic, and research applications. Therapeutic and diagnostic areas include cancer, antiviral treatment, autoimmune and inflammatory disease, allergy, cardiovascular disease, osteoporosis, and rheumatology.

Protein engineering and other efforts have generated mAbs with improved efficacy and targeting (e.g., bispecific mAbs), improved localization, tissue penetration, and blood clearance (e.g., single chain Fab variable fragments (scFvs), diabodies, minibodies, and other fragments), and altered immunostimulatory, safety, toxicity, and/or pharmacokinetic/pharmacodynamics properties, such as those containing modified Fc regions (e.g., through mutation or glycosylation). mAbs have been reengineered to permit site-specific conjugation of small molecules for improved delivery (e.g., ThioMABs) or to irreversibly bind to their cognate epitope (e.g., infinite affinity mAbs). mAbs have also been developed to improve the circulation and presentation of bioactive peptides and other biologics (e.g., CovX-bodies). Conjugation to various agents has allowed targeted immunotherapy and diagnostic methods. Hetero-multimeric scFvs and scFvs or mAbs fused to avidin have been developed for pre-targeted therapy and to improve the detection limits for tumor imaging.

Although mAbs can be effective and have advantages over small molecule approaches, existing antibodies and methods have various limitations. These can include adverse side effects resulting from off-target interactions, and/or collateral damage due to, among other things, long circulation times of antibody-drug conjugates. Additionally, while some antibodies are capable of binding to an epitope on a cell-surface antigen effectively, they may require internalization by the cell to produce a desired or intended result. Merely binding to the cognate antigen may not be sufficient to elicit a therapeutic response. Increasing the rate of internalization of a cell surface antigen could improve the efficacy of an antibody or antibody therapy. In view of these shortcomings, there is a need for improved antibodies and associated compounds, including those providing improved efficacy, synergy, specificity, and safety for both new and existing antibodies, and methods and uses of the same.

Provided herein are antibodies, compounds and compositions including peptides and other molecules, and related methods that address such needs.

SUMMARY

In some embodiments, provided herein is a recombinant meditope enabled antibody or antigen binding fragment thereof, containing a heavy chain containing a heavy chain variable (VH) region, a heavy chain constant region (CH) or portion thereof, and a light chain containing a light chain variable (VL) region, wherein each chain includes an amino terminus, a meditope binding site, a linker including a carboxy terminus, a rigid, alpha helical segment, a first flexible, unstructured segment, and an amino terminus, wherein the carboxy terminus of the linker is coupled to the amino terminus of the heavy chain or the light chain, and a cyclic peptide, wherein the cyclic peptide is coupled to the amino terminus of the linker, and wherein the cyclic peptide does not bind to the meditope binding site.

In some embodiments, the carboxy terminus of the linker and the cyclic peptide are separated by a distance of between 10-120 angstroms, including between about 10-100 angstroms and between about 10-80 angstroms. In some embodiments, the rigid, alpha helical segment of the linker includes the carboxy terminus of the linker. In some embodiments, the first flexible, unstructured segment of the linker includes the amino terminus of the linker.

In some embodiments, the amino terminus of the light chain or heavy chain is coupled to a carboxy terminus of the rigid, alpha helical segment of the linker, a carboxy terminus of the first flexible, unstructured segment of the linker is coupled to an amino terminus of the rigid, alpha helical segment of the linker, and the cyclic peptide is coupled to an amino terminus of the first flexible, unstructured segment of the linker.

In some embodiments, the linker further includes a second flexible, unstructured segment. In some embodiments, the second flexible, unstructured segment of the linker includes the carboxy terminus of the linker. In some embodiments, the amino terminus of the light chain or heavy chain is coupled to a carboxy terminus of the second flexible, unstructured segment of the linker, a carboxy terminus of the rigid, alpha helical segment of the linker is coupled to an amino terminus of the second flexible, unstructured segment of the linker, a carboxy terminus of the first flexible, unstructured segment of the linker is coupled to an amino terminus of the rigid, alpha helical segment of the linker, and the cyclic peptide is coupled to an amino terminus of the linker.

In some embodiments, the rigid alpha helical segment includes a sequence selected from the group consisting of SEQ ID NOS: 266-274. In some embodiments, the first flexible, unstructured segment of the linker includes SEQ ID NO: 265. In some embodiments, the second flexible, unstructured segment of the linker includes SEQ ID NO: 265.

In some embodiments, the cyclic peptide is capable of binding to a meditope binding site of a second meditope enabled antibody. In some embodiments, the cyclic peptide includes a meditope. In some embodiments, the meditope includes a peptide having the formula:

$$X1\text{-}X2\text{-}X3\text{-}X4\text{-}X5\text{-}X6\text{-}X7\text{-}X8\text{-}X9\text{-}X10\text{-}X11\text{-}X12 \quad \text{(formula V)}$$

wherein:

X1 is Cys, Gly, β-alanine, diaminopropionic acid, β-azidoalanine, or null;

X2 is Gln or null;

X3 is Phe, Tyr, β,β'-diphenyl-Ala, His, Asp, 2-bromo-L-phenylalanine, 3-bromo-L-phenylalanine, 4-bromo-L-phenylalanine, Asn, Gln, a modified Phe, a hydratable carbonyl-containing residue, or a boronic acid-containing residue;

X4 is Asp or Asn;

X5 is Leu; β,β'-diphenyl-Ala; Phe; a non-natural analog of phenylalanine, tryptophan, or tyrosine; a hydratable carbonyl-containing residue; or a boronic acid-containing residue;

X6 is Ser or Cys;

X7 is Thr, Ser or Cys;

X8 is Arg, a modified Arg, or a hydratable carbonyl-containing residue or boronic acid-containing residue;

X9 is Arg or Ala;

X10 is Leu; Gln; Glu; β,β'-diphenyl-Ala; Phe; a non-natural analog of phenylalanine, tryptophan, or tyrosine; a hydratable carbonyl-containing residue; or a boronic acid-containing residue;

X11 is Lys; and

X12 is Cys, Gly, 7-aminoheptanoic acid, β-alanine, diaminopropionic acid, propargylglycine, aspartic acid, isoaspartic acid, or null.

In some embodiments, the meditope includes an amino acid sequence selected from the group consisting of SEQ ID NO: 1, 2, 15, 16, 17, 18, 19, 20, 21, 22, 23, 24, 25, 26, 27, 28, 29, 30, 31, 32, 34, 35, 36, 37, 38, 39, 40, 41, 42, 43, 44, 45, 46, 47, 48, 49, 50, 51, 52, 53, 54, 55, 186, 187, 188, 189, and 207, or a cyclic peptide derived therefrom.

In some embodiments of the recombinant meditope enabled antibody of antigen binding fragment thereof, the heavy chain variable (VH) region includes an amino acid sequence selected from the group consisting of SEQ ID NO: 260-261, the light chain variable (VL) region includes an amino acid sequence selected from the group consisting of SEQ ID NO: 258-259, the rigid, alpha helical segment includes an amino acid sequence selected from the group consisting of SEQ ID NO: 266-274, the first flexible, unstructured segment includes an amino acid sequence of SEQ ID NO: 265, and the cyclic peptide includes an amino acid sequence selected from the group consisting of SEQ ID NO: 1, 2, 15, 16, 17, 18, 19, 20, 21, 22, 23, 24, 25, 26, 27, 28, 29, 30, 31, 32, 34, 35, 36, 37, 38, 39, 40, 41, 42, 43, 44, 45, 46, 47, 48, 49, 50, 51, 52, 53, 54, 55, 186, 187, 188, 189, or 207, or a cyclic peptide derived therefrom.

In some embodiments, provided herein is a recombinant meditope enabled antibody or antigen binding fragment thereof including a heavy chain including the amino acid sequence of SEQ ID NO: 255, 256, 277, 278, 279, 280, or 282.

In some embodiments, the meditope enabled antibody or antigen binding fragment specifically binds to a cell surface antigen. In some embodiments, the meditope enabled antibody or antigen binding fragment specifically binds to an antigen expressed by a disease or condition of a cell or tissue thereof. In some embodiments, the disease or condition is a cancer.

In some embodiments, the meditope enabled antibody or antigen binding fragment competes for antigen binding with, or binds to the same epitope as an antibody or antigen-binding fragment thereof selected from the group consisting of abagovomab, abciximab, adalimumab, adecatumumab, alemtuzumab, altumomab, altumomab pentetate, anatumomab, anatumomab mafenatox, arcitumomab, atlizumab, basiliximab, bectumomab, ectumomab, belimumab, benralizumab, bevacizumab, brentuximab, canakinumab, capromab, capromab pendetide, catumaxomab, certolizumab, clivatuzumab tetraxetan, daclizumab, denosumab, eculizumab, edrecolomab, efalizumab, etaracizumab, ertumaxomab, fanolesomab, fontolizumab, gemtuzumab, lintuzumab, girentuximab, golimumab, ibritumomab, igovomab, infliximab, ipilimumab, labetuzumab, mepolizumab, muromonab, muromonab-CD3, natalizumab, necitumumab nimotuzumab, ofatumumab, omalizumab, oregovomab, palivizumab, panitumumab, ranibizumab, rituximab, satumomab, sulesomab, ibritumomab, ibritumomab tiuxetan, tocilizumab, tositumomab, trastuzumab, ustekinumab, visilizumab, votumumab, zalutumumab, brodalumab, anrukinzumab, bapineuzumab, dalotuzumab, demcizumab, ganitumab, inotuzumab, mavrilimumab, moxetumomab pasudotox, rilotumumab, sifalimumab, tanezumab, tralokinumab, tremelimumab, and urelumab; or the meditope-enabled antibody or fragment specifically binds to an antigen selected from the group consisting of: CA-125, glycoprotein (GP) IIb/IIIa receptor, TNF-alpha, CD52, TAG-72, Carcinoembryonic antigen (CEA), interleukin-6 receptor (IL-6R), IL-2, interleukin-2 receptor a-chain (CD25), CD22, B-cell activating factor, interleukin-5 receptor (CD125), VEGF, VEGF-A, CD30, IL-1beta, prostate specific membrane antigen (PSMA), CD3, EpCAM, EGF receptor (EGFR), MUC1, human interleukin-2 receptor, Tac, RANK ligand, C5 or other complement proteins, CD11a, alpha-v beta-3 integrin, HER2, neu, CD15, CD20, Interferon gamma, CD33, CA-IX, CTLA-4, IL-5, CD3 epsilon, CAM, Alpha-4-integrin, IgE, IgE Fc region, an RSV antigen, F (or fusion) protein of respiratory syncytial virus (RSV), NCA-90 (granulocyte cell antigen), IL-6, GD2, GD3, IL-12, IL-23, IL-17, CTAA16.88, beta-amyloid, IGF-1 receptor (IGF-1R), delta-like ligand 4 (DLL4), alpha subunit of granulocyte macrophage colony stimulating factor receptor, hepatocyte growth factor, IFN-alpha, nerve growth factor, IL-13, CD326, CD19, PD-L1, CD47, and CD137.

In some embodiments, the meditope enabled antibody or antigen binding fragment is coupled to a therapeutic agent or diagnostic agent.

In some embodiments, the cyclic peptide is coupled to a therapeutic agent or diagnostic agent. In some embodiments, the therapeutic agent is selected from the group consisting of a chemotherapeutic agent, a therapeutic antibody, a toxin, a radioactive isotope, an enzyme, a chelator, a boron compound, a photoactive agent, a dye, a metal, a metal alloy, and a nanoparticle; or the diagnostic agent is an imaging agent selected from the group consisting of a fluorescent substance, a luminescent substance, a dye, and a radioactive isotope.

In some embodiments, provided herein is a method of crosslinking a first meditope enabled antibody or antigen binding fragment thereof and a second meditope enabled antibody or antigen binding fragment thereof, wherein the second meditope enabled antibody is any of the recombinant meditope enabled antibodies as described herein, the method including contacting a meditope binding site of the first meditope enabled antibody or antigen binding fragment thereof with a meditope of the second meditope enabled antibody, thereby resulting in crosslinking of the first and second meditope-enabled antibodies.

In some embodiments, provided herein is a method for altering the distribution of a cell surface antigen, including contacting a cell including a cell surface antigen with a plurality of any of the recombinant meditope enabled antibodies or antigen binding fragments as described herein, wherein the recombinant meditope enabled antibodies or antigen binding fragments are capable of binding to the cell surface antigen, and contacting a meditope binding site of a first meditope enabled antibody or antigen binding fragment thereof of the plurality of meditope enabled antibodies with a meditope from a second meditope enabled antibody from the plurality of meditope enabled antibodies, resulting in crosslinking of the first and second meditope-enabled antibodies, whereby crosslinking the first and second meditope enabled antibodies alters the distribution of the cell surface antigen.

In some embodiments, provided herein is a method for increasing co-localization of a cell surface antigen or cell surface receptor, including contacting a cell including a cell surface antigen with a plurality of any of the recombinant meditope enabled antibodies or antigen binding fragments provided herein, wherein the recombinant meditope enabled antibodies or antigen binding fragments are capable of binding to the cell surface antigen, and contacting a meditope binding site of a first meditope enabled antibody or antigen binding fragment thereof of the plurality of meditope enabled antibodies with a meditope from a second meditope enabled antibody from the plurality of meditope enabled antibodies, resulting in crosslinking of the first and second meditope-enabled antibodies, whereby crosslinking the first and second meditope enabled antibodies increases the co-localization of the cell surface antigen or receptor.

In some embodiments, provided herein is a method for increasing cellular internalization of a meditope enabled antibody, including contacting a cell including a cell surface antigen with a plurality of any of the recombinant meditope enabled antibodies or antigen binding fragments provided herein, wherein the recombinant meditope enabled antibodies or antigen binding fragments are capable of binding to the cell surface antigen, and contacting a meditope binding site of a first meditope enabled antibody or antigen binding fragment thereof of the plurality of meditope enabled antibodies with a meditope from a second meditope enabled antibody from the plurality of meditope enabled antibodies, resulting in crosslinking of the first and second meditope-enabled antibodies, whereby crosslinking the first and second meditope enabled antibodies increases cellular internalization of the first and second meditope enabled antibodies bound to the cell surface antigen.

In some embodiments, provided herein is a method for increasing cellular internalization of a cell surface antigen, including contacting a cell including a cell surface antigen with a plurality of any of the recombinant meditope enabled antibodies or antigen binding fragments provided herein, wherein the recombinant meditope enabled antibodies or antigen binding fragments are capable of binding to the cell surface antigen; and contacting a meditope binding site of a first meditope enabled antibody or antigen binding fragment thereof of the plurality of meditope enabled antibodies with a meditope from a second meditope enabled antibody from the plurality of meditope enabled antibodies, resulting in crosslinking of the first and second meditope-enabled antibodies, whereby crosslinking of the first and second meditope enabled antibodies increases cellular internalization of the first and second cell surface antigen.

In some embodiments, provided herein is a method of increasing the efficacy of an antibody therapy, including administering to a subject in need thereof an effective amount of a plurality of any of the recombinant meditope enabled antibodies or antigen binding fragments provided herein, wherein the recombinant meditope enabled antibodies or antigen binding fragments are capable of binding to a cell surface antigen, contacting a cell including the cell surface antigen with a first recombinant meditope enabled antibody or fragment of the plurality of recombinant meditope enabled antibodies or antigen binding fragments, contacting a meditope binding site of the first meditope enabled antibody or antigen binding fragment with a meditope from a second meditope enabled antibody of the plurality of recombinant meditope enabled antibodies, resulting in crosslinking of the first and second meditope-enabled antibodies, whereby crosslinking the first and second antibodies increases the efficacy of the antibody therapy.

In some embodiments, provided herein is a method of decreasing a dosage of an antibody therapy needed to achieve a desired therapeutic effect in a subject including administering to a subject in need thereof an effective amount of a plurality of any of the recombinant meditope enabled antibodies or antigen binding fragments provided herein, wherein the recombinant meditope enabled antibodies or antigen binding fragments are capable of binding to a cell surface antigen, contacting a cell including the cell surface antigen with a first recombinant meditope enabled antibody or fragment of the plurality of recombinant meditope enabled antibodies or antigen binding fragments, contacting a meditope binding site of the first meditope enabled antibody or antigen binding fragment with a meditope from a second meditope enabled antibody of the plurality of recombinant meditope enabled antibodies, resulting in crosslinking of the first and second antibodies, whereby crosslinking the first and second antibodies decreases the dosage of the antibody therapy needed to achieve the desired therapeutic effect in a subject.

In some embodiments, the first and second meditope enabled antibodies are the same or different. In some embodiments, at least one of the first or second meditope enabled antibodies or antigen-binding fragments specifically bind to an antigen expressed by a disease or condition of a cell or tissue thereof. In some embodiments, the disease or condition is a cancer. In some embodiments, the cell surface antigen is a receptor capable of receptor-mediated endocytosis.

In some embodiments, the cell surface antigen includes a plurality of cell surface antigens. In some embodiments, a first cell surface antigen of the plurality of cell surface antigens is different than a second cell surface antigen of the plurality of cell surface antigens, and the first recombinant meditope enabled antibody specifically binds to the first cell surface antigen and the second recombinant meditope enabled antibody specifically binds to the second cell surface antigen. In some embodiments, a first cell surface molecule includes the first cell surface antigen and the second cell surface antigen. In some embodiments, a first cell surface molecule includes the first cell surface antigen and a second cell surface molecule includes the second cell surface antigen.

In some embodiments, the method includes contacting a meditope binding site of the second meditope enabled antibody or fragment with a meditope of a third meditope enabled antibody or fragment, wherein the third meditope enabled antibody or fragment is any of the recombinant meditope enabled antibodies or fragments thereof provided herein, thereby resulting in crosslinking of the second and third meditope-enabled antibodies.

In some embodiments, provided herein is a method of inhibiting the crosslinking of a first meditope enabled antibody or antigen binding fragment thereof and a second meditope enabled antibody or antigen binding fragment thereof, wherein the second meditope enabled antibody is one of any of the recombinant meditope enabled antibodies or fragments, the method including contacting a meditope binding site of the first meditope enabled antibody or antigen binding fragment thereof with a free meditope, thereby inhibiting a meditope of the second meditope enabled antibody from contacting the meditope binding site of the first meditope enabled antibody, resulting in inhibiting the crosslinking of the first and second meditope-enabled antibodies.

In some embodiments, provided herein is a method of reducing the crosslinking of a first meditope enabled antibody or antigen binding fragment thereof and a second meditope enabled antibody or antigen binding fragment thereof, wherein the second meditope enabled antibody is one of any of the recombinant meditope enabled antibodies or antigen binding fragments thereof described herein, the method including contacting a meditope binding site of the first meditope enabled antibody or antigen binding fragment thereof with a free meditope, thereby reducing the ability of a meditope of the second meditope enabled antibody to contact the meditope binding site of the first meditope enabled antibody, resulting in reducing the crosslinking of the first and second meditope-enabled antibodies.

In some embodiments, provided herein is a method of disrupting the crosslinking of a first meditope enabled antibody or antigen binding fragment thereof and a second meditope enabled antibody or antigen binding fragment thereof, wherein the second meditope enabled antibody is one of any of the recombinant meditope enabled antibodies or antigen binding fragments thereof described herein, the method including contacting a meditope binding site of the first meditope enabled antibody or antigen binding fragment thereof with a free meditope, thereby displacing a meditope of the second meditope enabled antibody from the meditope binding site of the first meditope enabled antibody, resulting in disrupting the crosslinking of the first and second meditope-enabled antibodies.

In some embodiments, provided herein is a method of reversing the crosslinking of a first meditope enabled antibody or antigen binding fragment thereof and a second meditope enabled antibody or antigen binding fragment thereof, wherein the second meditope enabled antibody is one of any of the recombinant meditope enabled antibodies or antigen binding fragments described herein, the method including contacting a meditope binding site of the first meditope enabled antibody or antigen binding fragment thereof with a free meditope, thereby displacing a meditope of the second meditope enabled antibody from the meditope binding site of the first meditope enabled antibody, resulting in reversing the crosslinking of the first and second meditope-enabled antibodies.

In some embodiments, provided herein is a method of treatment, including administering an effective amount of any of the recombinant meditope enabled antibodies or antigen binding fragments described herein to a subject having a disease or condition. In some embodiments, the disease or condition is cancer. In some embodiments, the method further includes administering a chemotherapeutic agent to the subject.

In some embodiments, provided herein is a use of any of the recombinant meditope enabled antibodies or antigen binding fragments thereof provided herein in the manufacture of a medicament for the treatment of a disease or condition. In some embodiments, provided herein is a use of a combination of any of the antibody drug conjugates described herein and a chemotherapeutic agent in the manufacture of a medicament for the treatment a disease or condition. In some embodiments, the disease or condition is cancer.

In some embodiments, a method of reducing the effects of a meditope-enabled self-crosslinking antibody on a subject who has been administered the antibody includes administering free meditope to the subject. In some embodiments, the free meditope includes a peptide having the formula:

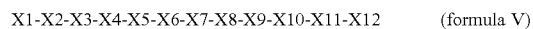

$$X1\text{-}X2\text{-}X3\text{-}X4\text{-}X5\text{-}X6\text{-}X7\text{-}X8\text{-}X9\text{-}X10\text{-}X11\text{-}X12 \quad \text{(formula V)}$$

wherein:
X1 is Cys, Gly, β-alanine, diaminopropionic acid, β-azidoalanine, or null;
X2 is Gln or null;
X3 is Phe, Tyr, β,β'-diphenyl-Ala, His, Asp, 2-bromo-L-phenylalanine, 3-bromo-L-phenylalanine, 4-bromo-L-phenylalanine, Asn, Gln, a modified Phe, a hydratable carbonyl-containing residue, or a boronic acid-containing residue;
X4 is Asp or Asn;
X5 is Leu; β,β'-diphenyl-Ala; Phe; a non-natural analog of phenylalanine, tryptophan, or tyrosine; a hydratable carbonyl-containing residue; or a boronic acid-containing residue;
X6 is Ser or Cys;
X7 is Thr, Ser or Cys;
X8 is Arg, a modified Arg, or a hydratable carbonyl-containing residue or boronic acid-containing residue;
X9 is Arg or Ala;
X10 is Leu; Gln; Glu; β,β'-diphenyl-Ala; Phe; a non-natural analog of phenylalanine, tryptophan, or tyrosine; a hydratable carbonyl-containing residue; or a boronic acid-containing residue;
X11 is Lys; and
X12 is Cys, Gly, 7-aminoheptanoic acid, β-alanine, diaminopropionic acid, propargylglycine, aspartic acid, isoaspartic acid, or null.

In some embodiments, the free meditope includes an amino acid sequence selected from the group consisting of SEQ ID NO: 1, 2, 15, 16, 17, 18, 19, 20, 21, 22, 23, 24, 25, 26, 27, 28, 29, 30, 31, 32, 34, 35, 36, 37, 38, 39, 40, 41, 42, 43, 44, 45, 46, 47, 48, 49, 50, 51, 52, 53, 54, 55, 186, 187, 188, 189, or 207, or a cyclic peptide derived therefrom.

In some embodiments, the method includes administering free meditope to the subject a plurality of times, optionally 2, 3, 4, 5, 6, 7, 8, 9, 10 or more times.

In some embodiments, the half-life of the free meditope is the same or about the same as the half-life of the meditope-enabled self-crosslinking antibody. In some embodiments, the half-life of the free meditope is longer than the half-life of the meditope-enabled self-crosslinking antibody. In some embodiments, the half-life of the free meditope is shorter than the half-life of the meditope-enabled self-crosslinking antibody.

In some embodiments, provided herein is a method of temporally controlling the effects of a meditope-enabled self-crosslinking antibody including administering a meditope-enabled self-crosslinking antibody to a subject in need thereof, administering one or more free meditopes to the subject, wherein the free meditope binds to a meditope binding site on the meditope-enabled self-crosslinking antibody, thereby reducing the ability of the antibody to self-crosslink.

In some embodiments, the step of administering one or more free meditopes to the subject occurs after the step of administering the meditope-enabled self-crosslinking antibody. In some embodiments, the method further includes administering one or more free meditopes a plurality of times. In some embodiments, the administering one or more free meditopes a plurality of times takes place over a period of minutes, hours, days, months, or years. In some embodiments, the half-life of the one or more free meditopes is shorter than the half-life of the meditope-enabled self-crosslinking antibody.

In some embodiments, the method further includes cessation of the administration of one or more free meditopes, thereby restoring the ability of the antibody to self-crosslink as the levels of free meditopes decrease. In some embodiments, the method further includes the restoration of the administration of one or more free meditopes one or more times, wherein the free meditope binds to a meditope binding site on the meditope-enabled self-crosslinking antibody, thereby reducing the ability of the antibody to self-crosslink.

In some embodiments, provided herein is a nucleic acid molecule including a sequence of nucleotides encoding a recombinant meditope enabled antibody or antigen binding fragment thereof provided herein. In some embodiments, the nucleic acid further includes a sequence of nucleotides encoding a free meditope. In some embodiments, the free meditope includes a peptide having the formula:

X1-X2-X3-X4-X5-X6-X7-X8-X9-X10-X11-X12    (formula V)

wherein:
X1 is Cys, Gly, β-alanine, diaminopropionic acid, β-azidoalanine, or null;
X2 is Gln or null;
X3 is Phe, Tyr, β,β'-diphenyl-Ala, His, Asp, 2-bromo-L-phenylalanine, 3-bromo-L-phenylalanine, 4-bromo-L-phenylalanine, Asn, Gln, a modified Phe, a hydratable carbonyl-containing residue, or a boronic acid-containing residue;
X4 is Asp or Asn;
X5 is Leu; β,β'-diphenyl-Ala; Phe; a non-natural analog of phenylalanine, tryptophan, or tyrosine; a hydratable carbonyl-containing residue; or a boronic acid-containing residue;
X6 is Ser or Cys;
X7 is Thr, Ser or Cys;
X8 is Arg, a modified Arg, or a hydratable carbonyl-containing residue or boronic acid-containing residue;
X9 is Arg or Ala;
X10 is Leu; Gln; Glu; β,β'-diphenyl-Ala; Phe; a non-natural analog of phenylalanine, tryptophan, or tyrosine; a hydratable carbonyl-containing residue; or a boronic acid-containing residue;
X11 is Lys; and
X12 is Cys, Gly, 7-aminoheptanoic acid, β-alanine, diaminopropionic acid, propargylglycine, aspartic acid, isoaspartic acid, or null.

In some embodiments, the free meditope includes an amino acid sequence selected from the group consisting of SEQ ID NO: 1, 2, 15, 16, 17, 18, 19, 20, 21, 22, 23, 24, 25, 26, 27, 28, 29, 30, 31, 32, 34, 35, 36, 37, 38, 39, 40, 41, 42, 43, 44, 45, 46, 47, 48, 49, 50, 51, 52, 53, 54, 55, 186, 187, 188, 189, or 207, or a cyclic peptide derived therefrom. In some embodiments, the free meditope encoded by the nucleic acid molecule is capable of binding to the meditope binding site on the recombinant meditope enabled antibody or antigen binding fragment thereof encoded by the nucleic acid molecule.

In some embodiments, the nucleic acid further includes at least one promoter operatively linked to control expression of the recombinant meditope enabled antibody or antigen binding fragment thereof. In some embodiments, the nucleic acid further includes at least one promoter operatively linked to control expression of the recombinant meditope enabled antibody or antigen binding fragment thereof and the free meditope. In some embodiments, the sequence of nucleotides encoding the recombinant meditope enabled antibody or antigen binding fragment thereof and the sequence of nucleotides encoding the free meditope are separated by an internal ribosome entry site (IRES), a sequence of nucleotides encoding a self-cleaving peptide, or a sequence of nucleotides encoding a peptide that causes ribosome skipping, optionally a T2A peptide. In some embodiments, the sequence of nucleotides encoding the recombinant meditope enabled antibody or antigen binding fragment thereof is operatively linked to a first promoter and the sequence of nucleotides encoding the free meditope is operatively linked to a second promoter, wherein the first and second promoter can be the same or different.

In some embodiments, at least one of the one or more promoters is a conditional promoter. In some embodiments, the conditional promoter is an inducible promoter. In some embodiments, the conditional promoter includes a Lac operator sequence, a tetracycline operator sequence, a galactose operator sequence or a doxycycline operator sequence, or is an analog thereof. In some embodiments, the conditional promoter is a repressible promoter. In some embodiments, the conditional promoter includes a Lac repressor or a tetracycline repressor, or is an analog thereof. In some embodiments, at least one of the one or more promoters is selected from the group consisting of CMV, RSV, PGK, EF1α, NSE, SV40, UBC, CAGG, synapsin, β-actin, and GFAP.

In some embodiments, provided herein is a vector including any of the nucleic acid molecules provided herein. In some embodiments, the vector is a pCEP4 vector, a viral vector, a retroviral vector, a lentiviral vector, or a gamma retroviral vector.

In some embodiments, provided herein is a cell including any of the nucleic acid molecules or vectors provided herein. In some embodiments, provided herein is a cell including a first nucleic acid or vector including a sequence of nucleotides encoding any of the recombinant meditope enabled antibodies or antigen binding fragments thereof provided herein and a second nucleic acid or vector including a sequence of nucleotides encoding a free meditope.

In some embodiments, the free meditope includes a peptide having the formula:

X1-X2-X3-X4-X5-X6-X7-X8-X9-X10-X11-X12    (formula V)

wherein:
X1 is Cys, Gly, β-alanine, diaminopropionic acid, β-azidoalanine, or null;
X2 is Gln or null;
X3 is Phe, Tyr, β,β'-diphenyl-Ala, His, Asp, 2-bromo-L-phenylalanine, 3-bromo-L-phenylalanine, 4-bromo-L-phenylalanine, Asn, Gln, a modified Phe, a hydratable carbonyl-containing residue, or a boronic acid-containing residue;
X4 is Asp or Asn;
X5 is Leu; β,β'-diphenyl-Ala; Phe; a non-natural analog of phenylalanine, tryptophan, or tyrosine; a hydratable carbonyl-containing residue; or a boronic acid-containing residue;
X6 is Ser or Cys;
X7 is Thr, Ser or Cys;
X8 is Arg, a modified Arg, or a hydratable carbonyl-containing residue or boronic acid-containing residue;
X9 is Arg or Ala;
X10 is Leu; Gln; Glu; β,β'-diphenyl-Ala; Phe; a non-natural analog of phenylalanine, tryptophan, or tyrosine; a hydratable carbonyl-containing residue; or a boronic acid-containing residue;

X11 is Lys; and

X12 is Cys, Gly, 7-aminoheptanoic acid, β-alanine, diaminopropionic acid, propargylglycine, aspartic acid, isoaspartic acid, or null.

In some embodiments, the free meditope includes an amino acid sequence selected from the group consisting of SEQ ID NO: 1, 2, 15, 16, 17, 18, 19, 20, 21, 22, 23, 24, 25, 26, 27, 28, 29, 30, 31, 32, 34, 35, 36, 37, 38, 39, 40, 41, 42, 43, 44, 45, 46, 47, 48, 49, 50, 51, 52, 53, 54, 55, 186, 187, 188, 189, or 207, or a cyclic peptide derived therefrom.

In some embodiments, the first vector further includes a first promoter operatively linked to control expression of the recombinant meditope enabled antibody or antigen binding fragment thereof and the second vector further includes a second promoter operatively linked to control expression of the free meditope, wherein the first promoter and second promoter can be the same or different. In some embodiments, at least one of the first promoter or the second promoter is a conditional promoter.

In some embodiments, the cell is a eukaryotic cell. In some embodiments, the cell is a mammalian cell. In some embodiments, the cell is a CHO cell, a HEK-293 cell, or a 293T cell.

In some embodiments, provided herein is a method of making a meditope-enabled self-crosslinking antibody or antigen binding fragment thereof, the method including culturing a host cell under conditions suitable for expression of the sequence of nucleotides encoding the recombinant meditope-enabled antibody or antigen binding fragment thereof; and isolating the antibody or antigen binding fragment thereof.

In some embodiments, provided herein is a method of making a meditope-enabled self-crosslinking antibody or antigen binding fragment thereof, the method including culturing a host cell under conditions suitable for expression of both the sequence of nucleotides encoding the recombinant meditope-enabled antibody or antigen binding fragment thereof and the sequence of nucleotides encoding the free meditope; and isolating the antibody or antigen binding fragment thereof and free meditope.

In some embodiments, the antigen binding fragment is a Fab, Fab', Fv, scFv, or F(ab')2 fragment.

In some embodiments, the method further includes conjugating a drug to the antibody or antigen binding fragment thereof.

In some embodiments, provided herein is an antibody or antigen binding fragment thereof produced by any of the methods provided herein. In some embodiments, provided herein is an antibody drug conjugate produced by any of the methods provided herein.

In some embodiments, provided herein is a composition including a plurality of any of the recombinant meditope enabled antibodies or antigen binding fragments thereof provided herein, or encoded by any of the nucleic acids provided herein, or expressed by the any of the vectors provided herein, expressed by any of the cells provided herein, or produced by any of the methods provided herein.

In some embodiments, the composition further includes a plurality of free meditopes.

In some embodiments, the free meditope includes the free meditope encoded by any of the nucleic acids provided herein, expressed by any of the vectors provided herein, expressed by any of the cells provided herein, or produced by the any of the methods provided herein.

In some embodiments, the free meditope includes a peptide having the formula:

$$X1\text{-}X2\text{-}X3\text{-}X4\text{-}X5\text{-}X6\text{-}X7\text{-}X8\text{-}X9\text{-}X10\text{-}X11\text{-}X12 \quad \text{(formula V)}$$

wherein:

X1 is Cys, Gly, β-alanine, diaminopropionic acid, β-azidoalanine, or null;

X2 is Gln or null;

X3 is Phe, Tyr, β,β'-diphenyl-Ala, His, Asp, 2-bromo-L-phenylalanine, 3-bromo-L-phenylalanine, 4-bromo-L-phenylalanine, Asn, Gln, a modified Phe, a hydratable carbonyl-containing residue, or a boronic acid-containing residue;

X4 is Asp or Asn;

X5 is Leu; β,β'-diphenyl-Ala; Phe; a non-natural analog of phenylalanine, tryptophan, or tyrosine; a hydratable carbonyl-containing residue; or a boronic acid-containing residue;

X6 is Ser or Cys;

X7 is Thr, Ser or Cys;

X8 is Arg, a modified Arg, or a hydratable carbonyl-containing residue or boronic acid-containing residue;

X9 is Arg or Ala;

X10 is Leu; Gln; Glu; β,β'-diphenyl-Ala; Phe; a non-natural analog of phenylalanine, tryptophan, or tyrosine; a hydratable carbonyl-containing residue; or a boronic acid-containing residue;

X11 is Lys; and

X12 is Cys, Gly, 7-aminoheptanoic acid, β-alanine, diaminopropionic acid, propargylglycine, aspartic acid, isoaspartic acid, or null.

In some embodiments, the free meditope includes an amino acid sequence selected from the group consisting of SEQ ID NO: 1, 2, 15, 16, 17, 18, 19, 20, 21, 22, 23, 24, 25, 26, 27, 28, 29, 30, 31, 32, 34, 35, 36, 37, 38, 39, 40, 41, 42, 43, 44, 45, 46, 47, 48, 49, 50, 51, 52, 53, 54, 55, 186, 187, 188, 189, and 207, or a cyclic peptide derived therefrom.

In some embodiments, the ratio of the recombinant meditope enabled antibody or antigen binding fragment thereof to the free meditope is between 1:1 and 1:1,000 including about 1:2, 1:3, 1:4, 1:5, 1:6, 1:7, 1:8, 1:10, 1:15, 1:20, 1:25, 1:50, 1:75, 1:100, 1:150, 1:200, 1:250, 1:300, 1:400, 1:500, and 1:750.

In some embodiments, the free meditope binds the meditope binding site of a recombinant meditope enabled antibody or antigen binding fragment thereof of the plurality of recombinant meditope enabled antibodies with a dissociation constant of less than at or about 10 μM, less than at or about 5 μM, or less than at or about 2 μM, less than at or about 1 μM, less than at or about 500, 400, 300, 200, 100 nM, or 200 picomolar or less.

In some embodiments, the plurality of recombinant meditope enabled antibodies or antigen binding fragments thereof includes a first and second recombinant meditope enabled antibodies or antigen binding fragments thereof, and the free meditope has an affinity for a meditope binding site of the first recombinant meditope enabled antibody or antigen binding fragment thereof that is greater than the affinity of a cyclic peptide coupled to the amino terminus of a linker of the second recombinant meditope enabled antibody or antigen binding fragment thereof for the meditope binding site of the first recombinant meditope enabled antibody or antigen binding fragment thereof.

In some embodiments, the free meditope has an affinity for a meditope binding site of the first recombinant meditope enabled antibody or antigen binding fragment thereof that is between 2× and 1,000,000× greater than the affinity of a cyclic peptide coupled to the amino terminus of a linker of the second recombinant meditope enabled antibody or antigen binding fragment thereof for the meditope binding site of the first recombinant meditope enabled antibody or antigen binding fragment thereof.

In some embodiments, the plurality of recombinant meditope enabled antibodies or antigen binding fragments thereof includes a first and second recombinant meditope enabled antibodies or antigen binding fragments thereof; and the free meditope has an affinity for a meditope binding site of the first recombinant meditope enabled antibody or antigen binding fragment thereof that is less than the affinity of a cyclic peptide coupled to the amino terminus of a linker of the second recombinant meditope enabled antibody or antigen binding fragment thereof for the meditope binding site of the first recombinant meditope enabled antibody or antigen binding fragment thereof.

In some embodiments, the free meditope has an affinity for a meditope binding site of the first recombinant meditope enabled antibody or antigen binding fragment thereof that is between 2× and 1,000,000× less than the affinity of a cyclic peptide coupled to the amino terminus of a linker of the second recombinant meditope enabled antibody or antigen binding fragment thereof for the meditope binding site of the first recombinant meditope enabled antibody or antigen binding fragment thereof.

In some embodiments, the plurality of recombinant meditope enabled antibodies or antigen binding fragments thereof includes a first and second recombinant meditope enabled antibodies or antigen binding fragments thereof, and the cyclic peptide coupled to the amino terminus of a linker of the second recombinant meditope enabled antibody or antigen binding fragment thereof binds the meditope binding site of the first recombinant meditope enabled antibody or antigen binding fragment thereof with dissociation constant of less than at or about 10 µM, less than at or about 5 µM, or less than at or about 2 µM, less than at or about 1 µM, less than at or about 500, 400, 300, 200, 100 nM, 200 picomolar or less.

In some embodiments, the composition has a pH of between 1 and 7.35 or between 7.45 and 13. In some embodiments, the plurality of recombinant meditope enabled antibodies or antigen binding fragments thereof includes a first recombinant meditope enabled antibody or antigen binding fragment thereof and a second recombinant meditope enabled antibody or antigen binding fragment thereof, wherein the affinity of a cyclic peptide coupled to the amino terminus of a linker of the second recombinant meditope enabled antibody or antigen binding fragment thereof for the meditope binding site of the first recombinant meditope enabled antibody or antigen binding fragment thereof is higher at a physiological pH than it is at a non-physiological pH.

In some embodiments, the free meditope has an affinity for a meditope binding site of the first recombinant meditope enabled antibody or antigen binding fragment thereof that is lower at a physiological pH than it is at a non-physiological pH. In some embodiments, the physiological pH is the pH at a cell or a tissue of a disease or a condition.

In some embodiments, provided herein is a pharmaceutical composition including a pharmaceutically acceptable carrier and any of the recombinant meditope enabled antibodies or antigen binding fragment thereof described herein, encoded by any of the nucleic acids or vectors described herein, expressed by any of the cells provided herein, produced by the any of the methods provided herein, or any of the compositions provided herein. In some embodiments, the pharmaceutical composition is in human unit dose form.

BRIEF DESCRIPTION OF THE DRAWINGS

FIG. 7A shows CD-33 expressing cells stained for fluorescence microscopy with pHrodo™-labeled SnAP-body variant 1, SnAP-body variant 2, or control antibody to determine receptor-mediated antibody endocytosis rates.

FIG. 9A shows results for the antibody control. FIG. 9B shows results for SnAP-body variant 1. FIG. 9C shows results for SnAP-body variant 2. FIG. 9D shows results for SnAP-body variant 3.

FIG. 13 shows that no adverse effects were observed for the tested agents including the SnAP-bodies.

DETAILED DESCRIPTION

Figure 1:
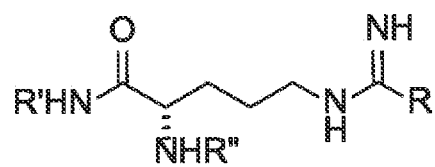
FIG. 1 shows a modified Arg8 residue that may be used to optimize meditope binding parameters, and may be used in accordance with the embodiments described herein (R=alkyl, substituted alkyl, aromatic or NHR''', where R'''=alkyl, substituted alkyl, or aromatic).

Provided herein are self-crosslinking recombinant meditope enabled antibodies or antigen binding fragments thereof comprising a linker and a meditope. The linkers of the invention are attached to the meditope and to the antibody or antigen binding fragment at an position on the antibody or antigen binding fragment thereof that permits the meditope-linker to facilitate the interaction or cross-linking of meditope enabled antibodies or antigen binding fragments thereof while not allowing for the meditope to bind to a meditope binding site present in the antibody to which the meditope-linker is attached. Self cross-linking antibodies or fragments thereof can form complexes with other meditope enabled antibodies via the linkers and meditopes. In one embodiment, the meditope enabled antibodies or antigen binding fragments thereof bind to one or more epitopes present on the surface of a cell. The ability of the described self-crosslinking antibodies or antigen binding fragments thereof to form complexes permits these antibodies or antigen binding fragments to alter the distribution of a cell surface antigen to which the plurality of antibodies or antigen binding fragments thereof bind. Complex formation through the interaction of the self-crosslinking antibodies and their cognate epitopes on the target antigen can increase or promote clustering or co-localization of a cell surface antigen on a cell, which can increase or promote internalization of the complex. In turn, the increased internalization can be used to clear or reduce the concentration of a cell surface antigen from the surface of a target cell and to increase the rate of internalization of the complex into the target cell. Increasing internalization rates can increase the efficacy of certain therapies, or reduce the amount of drug necessary to achieve a particular therapeutic effect. Methods of increasing or promoting clustering of a cell surface antigen can include administering to the cell one or more self-crosslinking antibodies that specifically bind to a cell-surface antigen, thereby promoting clustering of the cell-surface antigen on the surface of the target cell. In certain embodiments, the self-crosslinking antibodies are conjugated to one or more agents.

I. SELF-CROSSLINKING ANTIBODIES

Self-crosslinking meditope enabled antibodies or antigen binding fragments thereof comprise a linker, a meditope, and a meditope enabled antibody or antigen binding fragment thereof. The linker comprises a rigid segment and a flexible segment and is adapted to bind to a meditope.

The linkers described herein are designed such that the meditopes attached thereto generally do not bind to a meditope binding site contained within the same antibody, but bind preferentially to meditope binding sites on other meditope enabled antibodies or antigen binding fragments thereof. Typically the linkers are constructed repeating units, such as amino acids, that when assembled permit the linker to contain different structural features. For example, in some embodiments, the linker comprises a rigid segment with a limited or reduced range of motion. In some embodiments, this rigidity can prevent or reduce a meditope fused to the meditope-enabled antibody from binding to a meditope binding site on the same antibody or antigen binding fragment thereof.

In some embodiments, the linker comprises a flexible and/or unstructured segment. In some embodiments, the flexible and/or unstructured segment allows the linker to bend and/or rotate, thus allowing the meditope to bind to the meditope binding site of another antibody.

In some embodiments, when the linker is a peptide, the rigid segment typically comprises an amino acid sequence that produces a peptide with sufficient rigidity to limit the ability of the region to bend and/or rotate. In one embodiment, the rigid segment comprises an amino acid sequence that produces a peptide with an alpha helical structure. In another embodiment, the flexible and/or unstructured segment comprises an amino acid sequence that produces a peptide with sufficient flexibility to allow the flexible region to bend and/or rotate to allow the meditope sufficient flexibility to bind to meditope biding site.

A. Linkers

Provided herein are linkers as a component of the disclosed self-crosslinking meditope enabled antibodies or antigen binding fragments. The term "linker" as used herein refers to a structure by which a meditope is linked or connected to an antibody or antigen binding fragment thereof, including meditope enabled antibodies or antigen binding fragments thereof. The linker may be any structure suitable to link and separate the meditope from the antibody. Exemplary linkers may include one or more natural or unnatural amino acids which may be used to form a peptide, in some embodiments having a modified peptide backbone, a small chemical scaffold, a biotin-streptavidin, an organic or inorganic nanoparticle, a polynucleotide sequence, peptide-nucleic acids, or an organic polymer.

The linker may be attached to any portion of meditope enabled antibody or antigen binding fragment thereof. In one embodiment, the linker is attached to the amino terminus of the heavy chain or light chain of a meditope enabled antibody or antigen binding fragment thereof. In some embodiments, a linker with a meditope is attached to each heavy chain or each light chain of the self-crosslinking antibody or fragment. In some embodiments, a linker with a meditope is attached to one or more or all of the heavy chains and light chains of the self-crosslinking antibody. The linker can be attached to the antibody via a covalent and/or noncovalent bond.

1. Linker Structure

The linker can include various sequences or other structural features that provide various functions or properties. For example, it may be advantageous in some embodiments to reduce or inhibit the ability of a meditope at one end of the linker to bind a meditope binding site on the same meditope enabled antibody or antigen binding fragment thereof. In some embodiments, the linker may comprise one or more segments that are rigid, structured, ordered, or relatively rigid, structured, or ordered in some embodiments. As an exemplary advantage, a rigid segment can reduce the ability of the linker to bend or move, thereby reducing the ability of the linker to curve, turn, or fold in a manner that allows the meditope at one end of the linker to contact a meditope binding site on the same or different meditope enabled antibody or antigen binding fragment thereof.

In a preferred embodiment, the linker has sufficient rigidity to prevent meditope binding to the meditope binding site on the same side (e.g. ipsilateral) or the opposite side (e.g. contralateral) of the meditope enabled antibody or antigen binding fragment thereof. This reduction in meditope self-binding can enhance the self-crosslinking antibody's ability to bind other meditope enabled antibodies, for example by freeing up its meditope binding sites to bind meditopes linked to other meditope enabled antibodies or antigen binding fragments thereof.

The rigid, structured segment of the linker can comprise any peptide sequence or compound that reduces the ability of the linker to curve, turn, or fold in a manner that allows the meditope at one end of the linker to contact a meditope binding site on the same or other Fab region of the antibody. In some embodiments, the rigid, structured segment comprises a peptide. In some embodiments, the linker can contain one or more structural elements that comprise a rigid, alpha helical segment, region, domain, or peptide, which can include a sequence of amino acid residues which is prone to forming an alpha helix. In some embodiments, these sequences can include Met, Ala, Leu, Lys, Gln, Arg, Glu, Ser, and Pro amino acids, which may play a role in promoting alpha helical structures.

In some embodiments, hydrophobic residues can increase the interactions between different segments or domains of a protein. Hydrophobic residues include Gly, Ala, Val, Leu, Ile, Pro, Phe, Met, and Trp. Thus, in some embodiments, a rigid segment of the linker does not include, or includes a reduced number of, hydrophobic residues in order to reduce the interactions between the linker segments and/or between the linker and the meditope or antibody. In some embodiments, it may be advantageous for a rigid segment of the linker to include hydrophobic residues in order to increase the interactions between a plurality of alpha helices that comprise a rigid segment of a linker. Examples of rigid segments comprising a plurality of alpha helices include the four helix bundle 1FHA (SEQ ID NO: 272) and myoglobin 3RGK (SEQ ID NO: 273).

In some embodiments, the rigid, structured segment comprises a plurality of alpha helical segments, regions, domains, or peptides, including two, three, four, five, six, seven, eight, or more alpha helical segments. In some embodiments, the plurality of alpha helical segments are connected via turns, loops, and/or hairpins. Exemplary turns include one or more α-turns, β-turns, γ-turns, δ-turns, and π-turns. Hairpins include beta hairpins. Such turns, loops, and hairpins may allow folding between the plurality of rigid alpha helical segments. Folding can allow for the interaction between the alpha helical domains, and such interaction can enhance the rigidity of the rigid segment. In some embodiments, a rigid, structured segment comprises a $3_{10}$-helix or a π-helix, including, for example, at the carboxy or amino terminus of an alpha helix.

It may be advantageous in some embodiments to increase the ability of a meditope connected to an antibody via the linker to bind a meditope binding site of another meditope enabled antibody. Thus, in some embodiments, the linker includes structural features that enhance such binding. For example, in some embodiments, the linker optionally includes one or more segments that are unstructured, flexible, disordered, or relatively unstructured, flexible, or disordered. As an exemplary advantage, a flexible or disordered segment can increase the ability of the linker or a portion of the linker to bend or move, thereby increasing the ability of the linker to curve, turn, or fold in a manner that allows the meditope at one end of the linker to contact and/or remain bound to a meditope binding site on another meditope enabled antibody.

In some aspects, flexible segments of the linker can be designed to behave like a denatured peptide sequence under physiological conditions, such as having a large conformational freedom of the peptide backbone. In some examples, these segments are essentially devoid of secondary structure, e.g., at physiological conditions or in aqueous solutions. In some embodiments, a flexible segment can comprise one or more glycine residues, including one or more consecutive glycine residues. Glycine residues can disrupt protein structure, including alpha helices. This disruption can be in part because of glycine's minimal side chain, which can allow for increased flexibility. Thus, in some embodiments, a flexible segment of the linker includes 1, 2, 3, 4, 5, 6, or more glycine residues, including 1, 2, 3, 4, 5, 6, or more consecutive glycine residues. In some embodiments, a flexible segment can comprise one or more glycine residues and one or more proline residues. In some embodiments, a flexible segment of the linker comprises the amino acid sequence of SEQ ID NO: 265.

In some aspects, the linker has one or more of the following properties: unstructured conformation, conformational flexibility, enhanced aqueous solubility, high degree of protease resistance, low immunogenicity, low binding to mammalian receptors, a defined degree of charge, and increased hydrodynamic (or Stokes) radii. In some embodiments, the linker is systematically or randomly designed to prevent or cause steric hindrance of antibody/epitope interactions, antibody/antibody interactions, or antibody/meditope interactions. Example modifications include amino acid substitutions, additions, deletions, or modifications. In some embodiments, steric hindrance can prevent receptors from clustering, signaling, or from undergoing receptor-mediated endocytosis. In some embodiments, preventing steric hindrance can cause receptors to cluster, signal, or undergo receptor-mediated endocytosis.

Flexible segments can be used alone or can be combined with one or more rigid segments as described herein. For example, in some embodiments the linker is a compound having one or more chains (e.g., a polypeptide chain) having the formula:

$$L^{1A}\text{-}L^{2A} \qquad \text{(Formula I)}$$

where $L^{1A}$ is a rigid, structured segment and $L^{2A}$ is a flexible, unstructured segment of the linker.

In some embodiments the linker is a compound having one or more chains (e.g., a polypeptide chain) having the formula:

$$L^{2A}\text{-}L^{1A} \qquad \text{(Formula II)}$$

where $L^{2A}$ is a flexible, unstructured segment and $L^{1A}$ is a rigid, structured segment of the linker.

In some embodiments, the linker can include more than one flexible, unstructured segment. For example, in some embodiments the linker is a compound having one or more chains (e.g., a polypeptide chain) having the formula:

$$L^{2B}\text{-}L^{1A}\text{-}L^{2A} \qquad \text{(Formula III)}$$

where $L^{1A}$ is a rigid, structured segment and $L^{2A}$ and $L^{2B}$ are flexible, unstructured segments of the linker.

In some embodiments the linker is a compound having one or more chains (e.g., a polypeptide chain) having the formula:

$$L^{1A}\text{-}L^{2A}\text{-}L^{1B} \qquad \text{(Formula IV)}$$

where $L^{1A}$ and $L^{1B}$ are rigid, structured segments and $L^{2A}$ is a flexible, unstructured segment of the linker. Exemplary rigid linker segments include, but are not limited to, the peptide sequences encoded by SEQ ID NOS: 266-274.

2. Linker and Segment Length

The length of the rigid and flexible segments of the linker should be of a sufficient length that is optimally long enough to allow the meditope attached to the linker to bind a meditope binding site on another antibody. It may also be advantageous to use a linker that is short enough to prevent or reduce the binding of the meditope to a meditope binding site on the same meditope enabled antibody or antigen binding fragment thereof. In some embodiments the length of the linker can be at least 10 Å. In some embodiments the length of the linker is at least 10 Å and preferable less than 80 Å.

The distance between the amino terminus of the heavy chain of one Fab region and the meditope binding site of the contralateral fab region in the same antibody in some embodiments is ~80 Å. This distance can vary depending on the sequence, structure, and flexibility of the antibody. In some embodiments, the carboxy terminus of the linker and the meditope are separated by a distance of between 10-80, 10-70, 15-60, 20-50, or 25-40 Å. In some embodiments, the carboxy terminus of the linker and an end of the meditope are separated by a distance of between 10-80, 10-70, 15-60, 20-50, or 25-40 Å. In some embodiments, the length of a linker or linker segment can be varied by selecting an appropriate peptide sequence.

In some embodiments, the length of the linker can be determined by the number of amino acids that comprise the linker or linker segment. Alpha helical segments, described below, comprise a series of turns. Each turn of the helix can have a pitch of about 5.4 Å and comprises about 3.6 amino acid residues. Thus, the length of the linker can be adjusted by adding or removing amino acids. In some embodiments, the length of a linker or linker segment can be determined by the secondary or tertiary structure of the linker. As will be described below, in some embodiments the linker or segment comprises a peptide sequence that includes a plurality of folded alpha helices. In some embodiments, the length of the linker can be adjusted by modifying the secondary or tertiary structure of such peptides.

Controlling the position of the meditope and its ability to bind to meditope binding sites on other meditope enabled antibodies can also be enhanced in some embodiments by varying the length of the linker, or by varying the distance between one end of the linker and another end of the linker. For example, in some embodiments, a length of the linker is less than the distance between the amino terminus of the antibody chain to which the linker is connected and the meditope binding site on the same side of the meditope enabled antibody or antigen binding fragment thereof to which the linker is bound. In some embodiments, a length of the linker is less than a distance between the amino terminus of the antibody chain to which the linker is connected and the meditope binding site on the other side of the meditope enabled antibody or antigen binding fragment thereof to which the linker is bound.

Controlling the position of the meditope can also be enhanced in some embodiments by varying the length of the segments and composition of the linker. For example, in some embodiments, the length of the one or more rigid segments is longer than the length of the one or more flexible segments. This can reduce the likelihood that the meditope will bind to a meditope binding site on the same antibody by extending the meditope away from the antibody Fab regions with a longer rigid region than flexible region.

The length of the linker can also alter the geometry of the clustering. For instance, it may be advantageous to bring two receptors in close proximity, potentially leading to higher activity of the intracellular signaling molecules. Here, the linker between the antibody and meditope can be approximately 10 Å or more. Alternatively, it may be advantageous to keep receptors at a distance. Here, rigid linkers and/or longer linkers between the antibody and meditope can be used to "push" apart specific receptors.

In some aspects, the linker is designed to have a length that is the same or approximately the same as the distance between two receptors on a cell surface to be targeted. In some embodiments, the receptors can be the same or different. For example, the two receptors can comprise different amino acid sequences and/or different epitopes. In some contexts, two mAbs that recognize different epitopes on a single antigen act synergistically (see Kamat, V. et al., *Cancer Biol Ther* 7, 726-733 (2008)). In some examples, self-crosslinking antibodies have the flexibility of being able to pair up with any meditope enabled antibody. In some aspects, self-crosslinking antibody variants (e.g., generated by altering linker geometry) further enhance specificity and synergistic effects. Thus, in some examples, the length of the linker is designed to mimic or approximate the distance between a self-crosslinking antibody bound to a cell surface antigen and the meditope binding site of another antibody bound to a cell surface antigen.

A variety of methods have been established in the art to discern the presence or absence of secondary and tertiary structures in a given polypeptide. In particular, secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra. Secondary structure can also be predicted for a polypeptide sequence via certain computer programs or algorithms, such as the well-known Chou-Fasman algorithm (Chou, P. Y., et al. (1974) Biochemistry, 13:222-45) and the Garnier-Osguthorpe-Robson ("GOR") algorithm (Garnier J, Gibrat J F, Robson B. (1996), GOR method for predicting protein secondary structure from amino acid sequence. *Methods Enzymol* 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In one embodiment, the linker has an alpha-helix percentage ranging from 50% to more than about 95% as determined by the Chou-Fasman algorithm. In another embodiment, the linker has a beta-sheet percentage ranging from 0% to less than about 5% as determined by the Chou-Fasman algorithm. In some embodiments, the linker has an alpha-helix percentage ranging from 50% to more than about 95% and a beta-sheet percentage ranging from 0% to less than about 5% as determined by the Chou-Fasman algorithm. In some embodiments, the linker has an alpha helix percentage more than about 60%, more than about 65%, more than about 70%, more than about 75%, more than about 80%, more than about 85%, more than about 90%, or more than about 95% as determined by the Chou-Fasman algorithm. In some aspects, the linker is designed to avoid the presence of certain protease cleavage sites, such as sites for cleavage by serum protease(s) and/or to avoid immunogenicity.

Among the provided linkers are those having the amino acid sequence set forth as SEQ ID NO: 262, 263, and 264, or a modified variant thereof wherein any one, two, three, or four of the residues is optionally substituted with a conjugated amino acid, such as in place of a lysine residue.

3. Modifications

The linker can include various sequences or other structural features that provide various functions or properties to allow the linker to be derivatized. Exemplary structural elements include the presence or absence of a protease cleavage site, an immunogenic sequence, and residues, sites or tags including, for example aldehyde tags compatible with formylglycine-generating enzyme (FGE), lysines, tyrosines, glutamic acids, aspartic acids and unnatural amino acids, which can be used, for example in the conjugation of therapeutic or diagnostic agents.

In some aspects, the linkers of the provided compounds, such as a cleavage site for a protease present in the lysosomal compartment, e.g., MMP cleavage sites, ADAM cleavage sites, and/or cathepsin cleavage sites.

In some aspects, it contains no three contiguous amino acids that are identical unless the amino acids are serine or glycine or, has a subsequence score of less than 10, 9, 8, 7, 6, 5, 4, 3, or 2, or contains at least one residue other than glycine and serine. In some aspects, the linker does not contain a cleavage site for (or is not cleaved by) any serum protease, or for one or more or any of: proteins of the blood coagulation pathway family, Factors XIIIa, XIIa, XIa, Xa, IXa, and VIIa, thrombin, plasma kallikrein, activated PC, Prothrombinase, hK1, PSA/hK3, hK10, hK15, activated protein C (APC), Hageman factor (Coagulation factor XII), Factor Xa, ADAMTS13, von Willebrand factor-cleaving protease (VWFCP), protease nexin 2, Plasmin, Trypsin, α-chymotrypsin, matrix metalloproteinase-2, matrix metalloproteinase-9, Elastase, MASP-1 (mannose-binding lectin-associated serine protease-1), MASP-2, MASP-3, Cathepsin K, Cathepsin B, Streptokinase, Plasma Procarboxypeptidase B, Thrombin-Activatable Fibrinolysis Inhibitor (TAFI), plasminogen activator family (such as tissue plasminogen activator, urinary plasminogen activator (uPA)), Urokinase, complement convertase family proteins, Factor C1r, C1s, Factor D, and C3 convertases, such as C4b2a, C3bBb, and C3bBbC3b.

In some embodiments, the linkers are designed to avoid or reduce potential immunogenicity, such as by minimizing the likelihood of T cell epitope(s). The ability of a peptide to bind a given WIC Class II molecule for presentation on the surface of an antigen presenting cell (APC) is dependent on a number of factors, including the primary sequence of the peptide. In one aspect, a peptide or linker of the present disclosure has a low degree of immunogenicity due to its sequence being resistant to antigen processing in APCs. In another aspect, a peptide or linker of the present disclosure has a sequence that substantially does not bind an MHC receptor, or does not bind an MHC receptor in a degree sufficient to elicit an immune response. The present disclosure provides linkers and peptides comprising the linkers, wherein the linkers and peptides are substantially non-repetitive in the primary sequence and are designed to reduce binding with MHC II receptors. In other aspects, the peptides and linkers of the present disclosure do not form epitopes for T-cell receptor or antibody binding, resulting in a low degree of immunogenicity. In one aspect, avoidance of immunogenicity can attribute to, at least in part, a result of the conformational flexibility of the linker sequences; i.e., the lack of secondary structure due to the selection and order of amino acid residues. For example, sequences having a tendency to adapt compactly folded conformations in an aqueous solution or under a physiologic condition are more likely to result in conformational epitopes, than sequences having a relatively lower tendency to adapt compactly folded conformations in the aqueous solution or under the physiologic condition. The administration of fusion proteins comprising a linker of the present disclosure, using conventional therapeutic practices and dosing, would generally not result in the formation of neutralizing antibodies to the linker sequence. In one aspect, a linker sequence of low immunogenicity reduces the immunogenicity of the fusion partner, for example, when the linker is fused to linked to a meditope.

In one embodiment, the linker may contain or may be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. The same principles, e.g. the identification of epitopes, can be used to introduce such epitopes into the linker. Assays for human T cell epitopes have been described (Stickler, M., et al. (2003) *J Immunol Methods*, 281: 95-108). Of particular interest are peptide sequences that can be oligomerized with or without generating T cell epitopes or non-human sequences. This is achieved by testing direct repeats of these sequences for the presence of T-cell epitopes and for the occurrence of 6 to 15-mer and, in particular, 9-mer sequences that are not human, and then altering the design of the linker sequence to include or to eliminate or disrupt the epitope sequence. In some embodiments, the linker sequences are substantially non-immunogenic by the restriction of the numbers of epitopes of the linker predicted to bind MEW receptors. With a reduction in the numbers of epitopes capable of binding to MEW receptors, there is a concomitant reduction in the potential for T cell activation as well as T cell helper function, reduced B cell activation or up-regulation and reduced antibody production. The low degree of predicted T-cell epitopes can be determined by epitope prediction algorithms such as, e.g., TEPITOPE (Sturniolo, T., et al. (1999) *Nat Biotechnol*, 17: 555-61). The TEPITOPE score of a given peptide frame within a protein is the log of the $K_d$ (dissociation constant, affinity) of the binding of that peptide frame to multiple of the most common human MEW alleles, as disclosed in Sturniolo, T. et al. (1999) *Nature Biotechnology* 17:555). The score ranges over at least 20 logs, from about 10 to about −10 (corresponding to binding constraints of $10e^{10}$ $K_d$ to $10e^{-10}$ $K_d$), and can be reduced by avoiding hydrophobic amino acids that serve as anchor residues during peptide display on MEW, such as M, I, L, V, F. In some embodiments, a linker sequence does not have a predicted T-cell epitope at a TEPITOPE threshold score of about −5, or −6, or −7, or −8, or −9, or at a TEPITOPE score of −10. As used herein, a score of "−9" is a more stringent TEPITOPE threshold than a score of −5.

TEPITOPE scores of 9-mer peptide sequence can be calculated by adding pocket potentials as described by Sturniolo [Sturniolo, T., et al. (1999) *Nat Biotechnol*, 17: 555]. TEPITOPE scores calculated by this method range from approximately −10 to +10. However, 9-mer peptides that lack a hydrophobic amino acid (FKLMVWY)(SEQ ID NO: 240) in P1 position have calculated TEPITOPE scores in the range of −1009 to −989. This value is biologically meaningless and reflects the fact that a hydrophobic amino acid serves as an anchor residue for HLA binding and peptides lacking a hydrophobic residue in P1 are considered non binders to HLA.

In some embodiments, the linker is or is not predicted to contain any MHC Class II epitope, for example, as predicted by an epitope-identification program or algorithm. In one embodiment, a linker of the present disclosure has or is predicted to have 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 MHC Class II epitopes. In another embodiment, a linker disclosed herein has or is predicted to have no more than about 2, no more than about 3, no more than about 4, no more than about 5, no more than about 6, no more than about 7, no more than about 8, no more than about 9, no more than about 10, no more than about 11, no more than about 12, no more than about 13, no more than about 14, no more than about 15, no more than about 16, no more than about 17, no more than about 18, no more than about 19, no more than about 20, no more than about 21, no more than about 22, no more than about 23, no more than about 24, no more than about 25, no more than about 26, no more than about 27, no more than about 28, no more than about 29, or no more than about 30 MHC Class II epitopes.

In some embodiments, the linker may or may not contain any predicted MHC Class II epitope as predicted by the ProPred tool, which is described in Singh, H. and Raghava, G. P. S. (2001), ProPred: Prediction of HLA-DR binding sites, *Bioinformatics*, 17(12):1236-37. ProPred is a graphical web tool for predicting MHC Class II binding regions in antigenic protein sequences. In one aspect, prediction of MHC Class II epitope using the ProPred tool utilizes quantitative matrices derived from Sturniolo, T., et al. (1999), *Nat Biotechnol*, 17: 555.

Additionally, the non-repetitive sequence and corresponding lack of epitopes in a linker sequence limit or enhance the ability of B cells to bind to or be activated by the linker. A repetitive sequence is recognized and can form multivalent contacts with even a few B cells and, as a consequence of the cross-linking of multiple T-cell independent receptors, can stimulate B cell proliferation and antibody production. In contrast, while a linker can make contacts with many different B cells over its extended sequence, each individual B cell may only make one or a small number of contacts with an individual linker due to the lack of repetitiveness of the sequence. In one embodiment, a linker of the present disclosure typically has a much lower tendency to stimulate proliferation of B cells and thus an immune response. In one embodiment, a meditope fused to a linker has reduced immunogenicity as compared to the corresponding meditope that is not fused to a linker.

In one embodiment, a non-repetitive linker typically forms weaker contacts with an antibody than a linker with a high degree of repetitiveness. Antibodies are multivalent molecules, for example, IgGs have two identical binding sites and IgMs contain 10 identical binding sites. Thus antibodies against repetitive sequences can form multivalent contacts with such repetitive sequences with high avidity, which can affect the potency and/or elimination of such repetitive sequences. In contrast, antibodies against non-repetitive linkers likely yield only monovalent interactions, resulting in less likelihood of immune clearance such that a peptide comprising a non-repetitive linker can remain in circulation for an increased period of time.

A linker sequence can be evaluated to identify candidate MEW Class I epitopes, e.g. using an algorithm for the prediction of an MEW Class I epitope. Many different predictive programs are available for the identification of potential MEW Class I epitopes, i.e., epitopes that are capable of being displayed on an MEW Class I molecule, in a given polypeptide. A number of exemplary algorithms are described in WO 2009/051555, the disclosure of which is incorporated herein by reference for all purposes. Examples of epitope-identification programs can be found at the websites of the following organizations and facilities: Institute of Microbial Technology (India), ProPred-I tool as described in Singh, H. and Raghava, G. P. S. Bioinformatics 22; 19(8): 1009-14 (2003). SYFPEITHI, as described in Hans-Georg Rammensee, et al., *Immunogenetics* (1999) 50: 213-219. Immune Epitope Database. See e.g. Kim Y, Sidney J, Pinilla C, Sette A, Peters B., BMC *Bioinformatics* 10:394 (2009). Max-Planck-Institute for Infection Biology. See e.g. J. Hakenberg, A. Nussbaum, H. Schild, H.-G. Rammensee, C. Kuttler, H.-G. Holzhütter, P.-M. Kloetzel, S. H. E. Kaufmann, H.-J. Mollenkopf (2003) MAPPP-MHC-I Antigenic Peptide Processing Prediction. *Applied Bioinformatics* 2(3): 155-158. Technical University of Denmark, NetChop Server, as described in Nielsen M, Lundegaard C, Lund O, Kesmir C. *Immunogenetics*. 57 (1-2): 33-41, 2005.

The algorithms used within these prediction web sites can be found at the same sites. The following is a non-exhaustive list of references describing suitable prediction algorithms: Parker et al. (1994) Scheme for ranking potential HLA-A2 binding peptides based on independent binding of individual peptide side-chains, *J Immunol.*, 152, 163-175; Hans-Georg Rammensee et al. (1999) SYFPEITHI: database for MHC ligands and peptide motifs, *Immunogenetics* 50: 213-219; Reche et al. (2002) Prediction of MHC Class I binding peptides using profile motifs. *Hum Immunol.* 63 (9):701-9; Greenbaum et al. (2007) *Journal of Molecular Recognition* 20 (2):75-82.

In one embodiment, a linker of the present disclosure does not contain any epitope for an MHC receptor. In one embodiment, a linker of the present disclosure does not contain any MHC Class I or Class II epitope. In another embodiment, a linker disclosed herein does not contain any predicted MHC Class I epitope, for example, as predicted by an epitope-identification program or algorithm. In one embodiment, a linker of the present disclosure has or is predicted to have 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 MHC Class I epitopes. In another embodiment, a linker disclosed herein has or is predicted to have no more than about 2, no more than about 3, no more than about 4, no more than about 5, no more than about 6, no more than about 7, no more than about 8, no more than about 9, no more than about 10, no more than about 11, no more than about 12, no more than about 13, no more than about 14, no more than about 15, no more than about 16, no more than about 17, no more than about 18, no more than about 19, no more than about 20, no more than about 21, no more than about 22, no more than about 23, no more than about 24, no more than about 25, no more than about 26, no more than about 27, no more than about 28, no more than about 29, or no more than about 30 MHC Class I epitopes.

In some embodiments, the linker contains a reactive functionality, which can be used for derivatization, e.g., conjugation of the meditope, e.g., via the scaffold or linker, to an agent, such as a diagnostic, e.g., imaging agent or therapeutic agent. In some embodiments, the linker comprises one or more conjugation sites, including, for example, lysines, tyrosines, glutamic acids, aspartic acids, FGE sequences, or an unnatural amino acids useful in conjugating scaffolds, linkers, or agents. In some embodiments, the number and location of conjugation sites can be controlled by adding or removing conjugation sites, thereby controlling the amount or location of the subsequently conjugated agent. In some embodiments, a linker comprising a PASylation sequence, a sortase sequence, or an intein sequence further comprises one or more conjugation sites. For example, in some embodiments, the meditope comprises one or more PASylation sequences, including, for example, in the linker. PASylation sequences can comprise prolines, alanines, and serines in a defined or random sequence. PASylation sequences can therefore include peptides comprising neutral and hydrophobic amino acids. SEQ ID NO: 231 discloses an exemplary trivalent meditope. The sequence comprises PASylation is described in Morath, et al. *Mol Pharm* 2015 May 4; 12(5):1431-42. PASylation may improve drug delivery and prolong plasma half-life. For example PASylation my increase the hydrodynamic volume of a protein, thus prolonging circulation and/or boosting bioactivity before kidney filtration.

In some embodiments, thiol functionalities can be introduced in any suitable position on the linker and can be selectively modified using a number of external reagents containing diagnostic or therapeutic agents, such as imagining agents, other proteins and peptides, metal chelators, siRNAs, nanoparticles, cytotoxic agents, and the like.

For example, in some embodiments, the meditope, a modified variant thereof, or the linker comprises a sequence wherein any one, two, three, or four of the residues is optionally substituted with a conjugated amino acid, such as at a lysine. The chain in some embodiments is a conjugated peptidyl moiety, comprising a metal chelator bound to a metal ion, a small molecule, a chemotherapeutic agent, a therapeutic antibody or a functional fragment thereof, a toxin, a radioisotope, an enzyme, a nuclease, a hormone, an immunomodulator, an oligonucleotide, an organic or inorganic nanoparticle, an RNAi molecule, an siRNA, a chelator, a boron compound, a photoactive agent, a dye, a fluorescent or luminescent substance, an enzyme, an enhancing agent, a radioactive substance, or a chelator.

B. Meditopes

Provided herein are meditopes for use with the disclosed methods of altering the distribution of cell surface antigens, as well as vectors, cells, libraries, and other systems containing the same.

The term "meditope," as used herein, refers to a peptide or peptides that binds to a central cavity, such as a meditope-binding site of a meditope-enabled antibody or antigen binding fragment thereof, which antibody or antigen binding fragment thereof has a threonine at position 40, an asparagine at position 41, and an aspartate at position 85 of its light chain, according to Kabat numbering, or contains a meditope binding site containing residues that correspond to those within the meditope-binding site of cetuximab, meditope-enabled trastuzumab, or meditope-enabled M5A, disclosed herein. In some embodiments, meditopes can be fused to an antibody via a linker, as previously described. In some embodiments, the meditope is a free meditope. Exemplary meditopes include, but are not limited to, the cQFD (SEQ ID NO: 1) and cQYN (SEQ ID NO: 2) peptides and variants thereof ("meditope variants" or "variant meditopes"). Other molecules may also bind to meditope binding sites of meditope-enabled antibodies, with functional characteristics similar to those of a meditope. Such molecules, defined as "meditope analogs," may include, but are not limited to, small molecules, aptamers, nucleic acid molecules, peptibodies and any other substance able to bind to the same meditope binding site as a meditope. In some embodiments, the meditope sequence is cyclized as disclosed herein (e.g. the terminal (or near terminal) cysteine residues form a disulfide bond).

Among the provided meditopes are meditope variants (also called variant meditopes), having one or more modifications, e.g., structural modifications, as compared to meditope 1 or 2 (meditope of SEQ ID NO: 1 or 2), and methods for producing the same. In some embodiments, cQFD and cQYN meditopes are used as starting points in the design of meditope variants. In some aspects, the meditope variants are designed to have altered properties, such as increased or altered affinity, altered pH dependence, or different affinities under different physiological conditions for one or more of the provided meditope-enabled antibodies, including cetuximab and other antibodies described herein, e.g., as compared to the unmodified meditopes, cQFD and cQYN. Meditope variants are designed and produced using various chemical and biophysical methods.

Meditope variants include, but are not limited to, variants incorporating modifications to meditopes, e.g., cQFD and cQYN and others described herein. Suitable modifications include, but are not limited to, any peptide modification known in the art, such as, but not limited to, modifications to the manner and/or position of peptide cyclization, modifications to one or more amino acid components of the cyclic peptide, or adding or deleting one or more amino acid from the cyclic peptide. In a particular example, cQFD may be altered with one or more of the following modifications: a modification of Arg8, a modification of Phe3, a modification of Leu5, a modification of Leu10, change to the mode of peptide cyclization, and/or an incorporation of hydratable carbonyl functionality at one or more positions, and one or more amino acid deletions or additions. In the case of cQYN, suitable modifications may include one or more of the following: a modification of Arg8, a modification of Leu5, a modification of Leu10, change to the mode of peptide cyclization, and/or an incorporation of hydratable carbonyl functionality at one or more positions, and one or more deletions or additions. Certain amino acid positions within the meditope may be deleted or replaced with a different natural amino acid or an unnatural amino acid, or the meditope may be chemically conjugated with a fragment, for example by using "click chemistry". It is shown herein that a meditope in which Arg9 of SEQ ID NO: 1 has been mutated to citrulline binds to cetuximab. In addition, the amino and carboxy termini can be extended with further amino acids beyond (i.e., in addition to) the cyclic portion of the meditope variant in order to make additional contact to the Fab. For example, Protein L has been added to the C-terminus of the cQFD meditope and preliminary data shows that this binds with much higher affinity.

Also provided are self-crosslinking antibodies comprising meditopes with specific affinities for a meditope binding site of a meditope enabled antibody. In some embodiments, the self-crosslinking antibody comprises a meditope or variant with a low or reduced binding affinity for a meditope binding site, for example as compared to SEQ ID NO:1 or SEQ ID NO:2. In some embodiments, a self-crosslinking antibody comprising a meditope or variant with a low or reduced binding affinity can reduce or eliminate self-crosslinking under certain conditions. For example, it may be possible to use or store self-crosslinking antibodies with reduced self-crosslinking abilities at higher concentrations and/or without the need for additional free meditope. Such antibodies may be less likely to form large aggregates or precipitate out of solution during production or storage, yet still enhance antibody or antigen internalization where the concentration of antigen is high enough to promote antibody-antibody self-crosslinking interactions.

In some embodiments, the self-crosslinking antibody comprises a meditope or variant thereof with a high or increased binding affinity for a meditope binding site, for example as compared to SEQ ID NO:1 or SEQ ID NO:2. In some embodiments, a self-crosslinking antibody comprising a meditope or variant with a high or increased binding affinity can increase self-crosslinking under certain conditions. This may be advantageous, for example, for increasing antibody or antigen internalization when the concentration of an antigen is low or reduced on a particular cell surface. This may also be advantageous when administrations of lower amounts or concentrations of self-crosslinking antibody are desired.

In some embodiments, the meditopes include those listed in Tables 1 and 2, as well as such meditopes with additional amino acids, such as those up to 16 amino acids in length. For example, in some aspects, the meditope is one of meditopes 1, 2, or 15-55, further including a serine before the first residues, i.e., at position zero. The meditopes listed in Table 1 employ a disulfide linkage to connect the C and N termini, except that certain meditopes contain an additional sequence, such as a tail or a leader, such that the linkage is not between the two terminal residues. Exemplary tail and leader sequences are those having between 1 and 50 amino acids in length, such as between 1 and 40, 1 and 30, 1 and 25, 1 and 20, 1 and 15, 1 and 10, 9, 8, 7, 6, 5, 4, 3, or 2 amino acids in length, such as the tails set forth as R5A and R5B, herein. Exemplary tails and leader sequences contain any one or more G, S, P, K, and/or D residue(s). Exemplary tails and leaders include GGGSK, G, GPGGSDPG, and GPGGSDPG. For example, the meditope having SEQ ID NO: 31 contained an additional tail, meaning that the disulfide linkage is not between the two terminal residues. Likewise, certain other meditopes in the table (SEQ ID NOS: 187-190, 207) contain tails and/or leaders, resulting in linkage between residues other than the terminal residues. For the peptides in Table 2, a lactam bridge, a linkage other than disulfide (such as [3+2] cycloaddition), or no linkage is used (e.g., an acyclic or linear variant). Additional meditopes that may be used according to the embodiments described herein include any meditope as defined herein that binds to an antibody framework binding interface (i.e., between the Fab light and heavy chains) of cetuximab or any other therapeutic antibody. For example, in addition to the cyclic peptides cQFD and cQYN, some embodiments include one or more variants of cQFD and cQYN.

TABLE 1

| SEQ ID NO | Meditope Number | Sequence | Modificaiton | Linkgage method |
|---|---|---|---|---|
| 1 | 1 | C-QFDLSTRRLK-C | original | Disulfide 1Cys:12Cys |
| 2 | 2 | C-QYNLSSRALK-C | original | Disulfide 1Cys:12Cys |
| 15 | 15 | C-qFDLSTRRLK-C | q = D-glutamine | Disulfide 1Cys:12Cys |
| 16 | 16 | C-QYDLSTRRLK-C | Y = tyrosine | Disulfide 1Cys:12Cys |
| 17 | 17 | C-QXDLSTRRLK-C | X = β-β'-di-phenyl-Ala | Disulfide 1Cys:12Cys |
| 18 | 18 | C-QFDXSTRRLK-C | X = β-β'-di-phenyl-Ala | Disulfide 1Cys:12Cys |
| 19 | 19 | C-QFDFSTRXLK-C | F = phenylalanine, X = citrulline | Disulfide 1Cys:12Cys |
| 20 | 20 | C-QFDFSTRRLK-C | F = phenylalanine | Disulfide 1Cys:12Cys |
| 21 | 21 | C-QFDESTRRLK-C | E = glutamic acid | Disulfide 11Cys:12Cys |
| 22 | 22 | C-QFDYSTRRLK-C | Y = tyrosine | Disulfide 1Cys:12Cys |
| 23 | 23 | C-QFDLSTRRQK-C | Q = glutamine | Disulfide 1Cys: 12Cys: |
| 24 | 24 | C-QFDLSTRQLK-C | Q = glutamine | Disulfide 1Cys: 12Cys: |
| 25 | 25 | C-QYNLSTARLK-C | Y = tyrosine; N = asparagine; A = alanine | Disulfide 1Cys: 12Cys: |
| 26 | 26 | C-QADLSTRRLK-C | A = alanine | Disulfide 1Cys:12Cys |
| 27 | 27 | C-QFDASTRRLK-C | A = alanine | Disulfide 1Cys:12Cys |
| 28 | 28 | C-QFDLSTARLK-C | A = alanine | Disulfide 1Cys:12Cys |
| 29 | 29 | C-QFDLSTRRAK-C | A = alanine | Disulfide 1Cys:12Cys |
| 30 | 30 | C-QFDLSTRREK-C | E = glutamic acid | Disulfide 1Cys:12Cys |
| 31 | 31 | AcC-QFDLSTRRLR-CGGGSK | AcC-N-acetylcysteine R = arginine | Disulfide 1-AcCys:12-Cys |

TABLE 1-continued

| SEQ ID NO | Meditope Number | Sequence | Modification | Linkage method |
|---|---|---|---|---|
| 186 | | C-QFDLSTRRLR-C | R = arginine | Disulfide 1Cys:12Cys |
| 187 | | GC-QFDLSTRRLR-C | R = arginine | Disulfide 2Cys:13Cys |
| 188 | | GPGGSDPGC-QFDLSTRRLR-C | R = arginine | Disulfide 9Cys:20Cys |
| 189 | | C-QFDLSTRRLR-CG | R = arginine | Disulfide 1Cys:12Cys |
| 190 | | GPGGSDPGC-QFDLSTRRLR-CG | R = arginine | Disulfide 9Cys:20Cys |
| 207 | | GC-QFDLSTRRLR-CG | R = arginine | Disulfide 2Cys:13Cys |

TABLE 2

| SEQ ID NO | Sequence | Modification | Linkage method |
|---|---|---|---|
| 32 | 32 G-QFDLSTRRLK-G | G = glycine | Lactam 1-Gly:12-Gly |
| 33 | 33 G-QHDLSTRRLK-G | H = histidine | Lactam 1-Gly:12-Gly |
| 34 | 34 G-QNDLSTRRLK-G | N = asparagine | Lactam 1-Gly:12-Gly |
| 35 | 35 G-QQDLSTRRLK-G | Q = glutamine | Lactam 1-Gly:12-Gly |
| 36 | 36 G-QXDLSTRRLK-G | X = 2-bromo-L-phenylalanine | Lactam 1-Gly:12-Gly |
| 37 | 37 G-QXDLSTRRLK-G | X = 3-bromo-L-phenylalanine | Lactam 1-Gly:12-Gly |
| 38 | 38 G-QXDLSTRRLK-G | X = 4-bromo-L-phenylalanine | Lactam 1-Gly: 12-Gly |
| 39 | 39 G-QFDLSTRXLK-G | X = citrulline | Lactam 1-Gly:12-Gly |
| 40 | 40 G-QFDLSTXXLK-G | X = citrulline | Lactam 1-Gly:12-Gly |
| 41 | 41 G-QFDLSTXRLK-G | X = citrulline | Lactam 1-Gly:12-Gly |
| 42 | 42 Q-FDLSTRRLK-X | X = 7-aminoheptanoic acid | Lactam 1-Gln:11-X |
| 43 | 43 X-QFDLSTRRLK-X | X = β-alanine | Lactam 1-X:12-X |
| 44 | 44 X-QFDLSTRRLK-X' | X = diaminopropionic acid; X' = iso-aspartic acid | Lactam 1-X:12-X' |
| 45 | 45 X-QFDLSTRRLK-X' | X = β-alanine; X' = iso-aspartic acid | Lactam 1-X:12-X' |
| 46 | 46 X-QFDLSTRRLK-X' | X = diaminopropionic acid; X' = β-alanine | Lactam 1-X:12-X' |
| 47 | 47 F-DLSTRRL-K | | Lactam 1-Phe:9-Lys |
| 48 | 48 C-QFDLSTRRLK-C | | Disulfide 1-Cys:12-Cys; Lactam 4-Asp to 11-Lys |
| 49 | 49 Q-YDLSTRRLK-X | Y = tyrosine, X = 7-aminoheptanoic acid | Lactam 1-Gln:11-X |
| 50 | 50 X-QFDLSTRRLK-X' | X = β-azidoalanine, X' = propargylglycine | [3 + 2] cycloaddition Azide-1-X: alkyne-12-X' |
| 51 | 51 Q-XDLSTRRLK-X' | X = β-β'-di-phenyl-Ala, X' = 7-aminoheptanoic acid | Lactam 1-Gln:11-X' |
| 52 | 52 qFDLSTRRLK-X | q = D-glutamine, X = 7-aminoheptanoic acid | Lactam 1-Gln:11-X |
| 53 | 53 Q-XDXSTRRLK-X' | X = β-β'-di-phenyl-Ala, X' = 7-aminoheptanoic acid | Lactam 1-Gln:11-X' |

TABLE 2-continued

| SEQ ID NO | Sequence | Modification | Linkage method |
|---|---|---|---|
| 54 | 54 Q-FDLSTXRLK-X' | X = n-butyl-arginine, X' = 7-aminoheptanoic acid | Lactam 1-Gln:11-X' |
| 55 | 55 <u>S</u>QFDLSTRRLK<u>S</u> | | No linkage |

The meditope variants typically have an amino acid sequence length of between 5 and 16 amino acids, e.g., 5, 6, 7, 8, 9, 10, 11, 12, 13, 14, 15, or 16 amino acids in length, such as between 8 and 13 amino acids in length, e.g., between 9 and 12 amino acids in length. The meditope can additionally be conjugated to or associated with (e.g., as part of a fusion protein or peptide) with another molecule, such as another peptide, including a linker or agent. Thus, in this case, the compound containing the meditope may contain additional amino acid residues beyond the lengths described in this paragraph, where the meditope portion contains between 5 and 16 amino acids and the complex or compound contains additional amino acids. Examples are described herein, e.g., SEQ ID NO: 31 above.

In some embodiments, the variant meditopes are cyclic peptides. In other embodiments, they are linear or acyclic peptides.

The meditopes can include peptides, or cyclic peptides derived from such peptides, for example, where the peptides have the formula:

X1-X2-X3-X4-X5-X6-X7-X8-X9-X10-X11-X12 (Formula V), for example, where:
X1=Cys, Gly, β-alanine, diaminopropionic acid, β-azido-alanine, or null;
X2=Gln or null;
X3=Phe, Tyr, β-β'-diphenyl-Ala, His, Asp, 2-bromo-L-phenylalanine, 3-bromo-L-phenylalanine, or 4-bromo-L-phenylalanine, Asn, Gln, a modified Phe, a hydratable carbonyl-containing residue; or a boronic acid-containing residue;
X4=Asp or Asn;
X5=Leu; β-β'-diphenyl-Ala; Phe; Trp; Tyr; a non-natural analog of phenylalanine, tryptophan, or tyrosine; a hydratable carbonyl-containing residue; or a boronic acid-containing residue;
X6=Ser;
X7=Thr or Ser;
X8=Arg, Ser, a modified Arg, or a hydratable carbonyl or boronic acid-containing residue;
X9=Arg, Ala;
X10=Leu, Gln, Glu, β-β'-diphenyl-Ala; Phe; Trp; Tyr; a non-natural analog of phenylalanine, tryptophan, or tyrosine; a hydratable carbonyl-containing residue; or a boronic acid-containing residue;
X11=Lys; and
X12=Cys, Gly, 7-aminoheptanoic acid, β-alanine, diaminopropionic acid, propargylglycine, aspartic acid, isoaspartic acid, or null.

In some aspects, the modified Arg has a structure of the formula shown in FIG. 1. In some aspects, the modified Phe is a Phe with one or more halogen incorporated into the phenyl ring. In some aspects, formula V is not SEQ ID NO: 1 or SEQ ID NO: 2.

In some embodiments, the meditopes are peptides having the structure of Formula (VI):

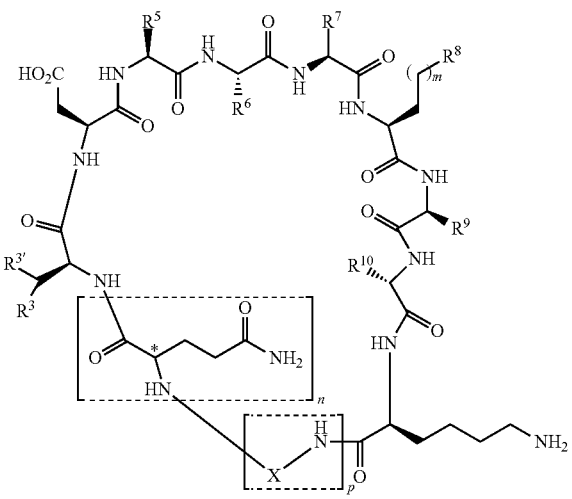

(VI)

wherein:
the center marked with "*" is in the "R" or "S" configuration;
$R^3$ and $R^{3'}$ are independently H or phenyl, optionally substituted with one, two, or three substituents independently selected from $C_{1-4}$alkyl, —OH, fluoro, chloro, bromo, and iodo;
$R^5$ is:
(A) $C_{1-8}$alkyl, optionally substituted with one or more substituents selected from oxo, acetal, ketal, —B(OH)$_2$, boronic ester, phosphonate ester, ortho ester, —CO$_2$C$_{1-4}$alkyl, —CH═CH—CHO, —CH═CH—C(O)C$_{1-4}$alkyl, —CH═CH—CO$_2$C$_{1-4}$alkyl, —CO$_2$H, and —CONH$_2$; or
(B) $C_{1-4}$alkyl substituted with:
  a) one or two phenyl, wherein each phenyl is optionally substituted with one, two, or three substituents independently selected from —OH, fluoro, chloro, bromo, and iodo; or
  b) naphthyl, imidazole, or indole;
$R^6$ is —C$_{1-4}$alkylene-OH or —C$_{1-4}$alkylene-SH;
$R^7$ is —C$_{1-4}$alkylene-OH or —C$_{1-4}$alkylene-SH;
m is 0, 1, 2, 3, 4, or 5;
$R^8$ is:
(a) —OH, —NR$^a$R$^b$, —N(R$^c$)C(O)R$^e$, or —N(R$^c$)C(═NR$^d$)R$^e$;
wherein:
$R^a$ is H;
$R^b$ is H or C$_{1-8}$alkyl optionally substituted with one or more substituents selected from the group consisting of oxo, acetal, ketal, —B(OH)$_2$, —SH, boronic ester, phosphonate ester, ortho ester, —CH═CH—CHO, —CH═CH—C(O)C$_{1-4}$alkyl, —CH═CH—CO$_2$C$_{1-4}$ alkyl, —CO$_2$H, and —CO$_2$C$_{1-4}$alkyl;

R$^c$ is H, C$_{1-8}$alkyl, C$_{3-8}$cycloalkyl, branched alkyl, or aryl;

R$^d$ is H or a C$_{1-8}$alkyl, C$_{2-8}$alkenyl, C$_{2-8}$alkynyl, C$_{3-8}$cycloalkyl, branched alkyl, or aryl group, each optionally substituted with one or more substituents selected from the group consisting of —N$_3$, —NH$_2$, —OH, —SH, halogen, oxo, acetal, ketal, —B(OH)$_2$, boronic ester, phosphonate ester, ortho ester, —CH═CH—CHO, —CH═CH—C(O)C$_{1-4}$alkyl, —CH═CH—CO$_2$C$_{1-4}$alkyl, —CO$_2$H, and —CO$_2$C$_{1-4}$alkyl group;

R$^e$ is H, —NHR$^d$, or a C$_{1-12}$alkyl, C$_{3-8}$cycloalkyl, C$_{2-12}$alkenyl, C$_{2-8}$alkynyl, or aryl group, each optionally substituted with one or more substituents selected from the group consisting of —N$_3$, —NH$_2$, —OH, —SH, oxo, C$_{2-4}$acetal, C$_{2-4}$ketal, —B(OH)$_2$, boronic ester, phosphonate ester, ortho ester, —CH═CH—CHO, —CH═CH—C(O)C$_{1-4}$alkyl, —CH═CH—CO$_2$C$_{1-4}$alkyl, and —CO$_2$C$_{1-4}$alkyl; or (b) C$_{1-12}$ alkyl substituted with an oxo, acetal, ketal, —B(OH)$_2$, boronic ester, —SH, —OH, phosphonate ester, ortho ester, —CH═CH—CHO, —CH═CH—C(O)C$_{1-4}$alkyl, —CH═CH—CO$_2$C$_{1-4}$alkyl, or —CO$_2$C$_{1-4}$alkyl;

R$^9$ is C$_{1-4}$alkyl or —C$_{1-2}$alkylene-R$^x$;
wherein R$^x$ is —CO$_2$H, —CONH$_2$, —CH$_2$NHC(O)NH$_2$, or —CH$_2$NHC(═NH)NH$_2$;

R$^{10}$ is:
(1) C$_{1-8}$alkyl optionally substituted with one or more substituents selected from the group consisting of oxo, acetal, ketal, —B(OH)$_2$, boronic ester, phosphonate ester, ortho ester, —CH═CH—CHO, —CH═CH—C(O)C$_{1-4}$alkyl, —CH═CH—CO$_2$C$_{1-4}$alkyl, —CO$_2$C$_{1-4}$ alkyl, —CO$_2$H, and —CONH$_2$; or
(2) C$_{1-4}$alkyl substituted with one or two phenyl, or one naphthyl, imidazole, or indole, wherein each phenyl is optionally substituted with one, two, or three substituents independently selected from —OH, fluoro, chloro, bromo, and iodo;

n is 0 or 1;
p is 0 or 1;
X is C$_{1-8}$alkylene or C$_{2-8}$alkenylene, each carbon thereof optionally substituted with oxo, —C(O)—, —NHC(O)—, —CO$_2$H, —NH$_2$, or —NHC(O)R$^y$;
wherein one carbon of said alkylene is optionally replaced with —C(O)NH—, a 5-membered heteroaryl ring, or —S—S—; and
R$^y$ is —C$_{1-4}$alkyl, —CH(R$^c$)C(O)— or —CH(R$^z$)CO$_2$H;
R$^z$ is —H or —C$_{1-4}$alkyl optionally substituted with —OH, —SH, or —NH$_2$;
or a pharmaceutically acceptable salt thereof.

In some cases X is C$_{1-8}$alkylene or C$_{2-8}$alkenylene, each carbon thereof optionally substituted with oxo, —CO$_2$H, —NH$_2$, or —NHC(O)R$^y$; wherein one carbon of said alkylene is optionally replaced with —C(O)NH—, —NHC(O)—, a 5-membered heteroaryl ring, or —S—S—; one carbon of said alkenylene is optionally replaced with —NHC(O)—; and R$^y$ is —C$_{1-4}$alkyl, —CH(R$^c$)C(O)— or —CH(R$^z$)CO$_2$H; R$^z$ is —H or —C$_{1-4}$alkyl optionally substituted with —OH, —SH, or —NH$_2$; or a pharmaceutically acceptable salt thereof.

In some cases X is C$_{1-8}$alkylene or C$_{2-8}$alkenylene, each of which is optionally substituted with —CO$_2$H, —NH$_2$, or —NHC(O)R$^y$; wherein one carbon of said alkylene is optionally replaced with —C(O)NH—, a 5-membered heteroaryl ring, or —S—S—; and R$^y$ is —C$_{1-4}$alkyl or —CH(R$^z$)CO$_2$H; wherein R$^z$ is —H or —C$_{1-4}$alkyl optionally substituted with —OH, —SH, or —NH$_2$; or a pharmaceutically acceptable salt thereof.

In some cases, such meditopes are not SEQ ID NO: 1 or 2, or are not cyclic peptides derived from such sequences, and/or are not meditope 1 or 2.

In some embodiments of the meditope of Formula (VI), m is 0, 1, or 2. In other embodiments, R$^3$ is H or phenyl and R$^{3'}$ is phenyl, 2-bromophenyl, 3-bromophenyl, or 4-bromophenyl. In further embodiments, R$^5$ is methyl, ethyl, propyl, isopropyl, butyl, isobutyl, sec-butyl, or tert-butyl, each optionally substituted with an oxo, —B(OH)$_2$, —CO$_2$H, or —CONH$_2$ group, or with one or two phenyl groups each optionally substituted with a bromo or chloro substituent. In further embodiments, R$^8$ is —OH, —NH$_2$, —N(R$^c$)C(O)R$^e$, or —N(R$^c$)C(═NR$^d$)R$^e$. In still further embodiments, R$^c$ is H or methyl, R$^d$ is H or C$_{1-4}$alkyl, and R$^e$ is C$_{1-4}$alkyl, or —NH(C$_{1-4}$alkyl). In other embodiments, R$^9$ is methyl or ethyl, optionally substituted with —CO$_2$H, —CONH$_2$, —CH$_2$NHC(O)NH$_2$, or —CH$_2$NHC(═NH)NH$_2$. In still other embodiments, R$^{10}$ is methyl, ethyl, propyl, isopropyl, butyl, isobutyl, sec-butyl, or tert-butyl, each optionally substituted with an oxo, —B(OH)$_2$, —CO$_2$H, or —CONH$_2$ group. In still other embodiments, —X—NH— is -Cys-Cys-, -Gly-Gly-, —C(O)(CH$_2$)$_6$—NH—, —C(O)CH(NH$_2$)CH$_2$CH═CHCH$_2$CH(CO$_2$H)—NH—, —C(O)CH(NH$_2$)CH$_2$NHC(O)CH$_2$CH(CO$_2$H)—NH—, -β-Ala-C(O)CH$_2$CH(CO$_2$H)—NH—, or —C(O)CH(NH$_2$)CH$_2$-triazinyl-CH$_2$—CH(CO$_2$H)—NH—.

In some embodiments, the meditopes are peptides having the structure of Formula (VII):

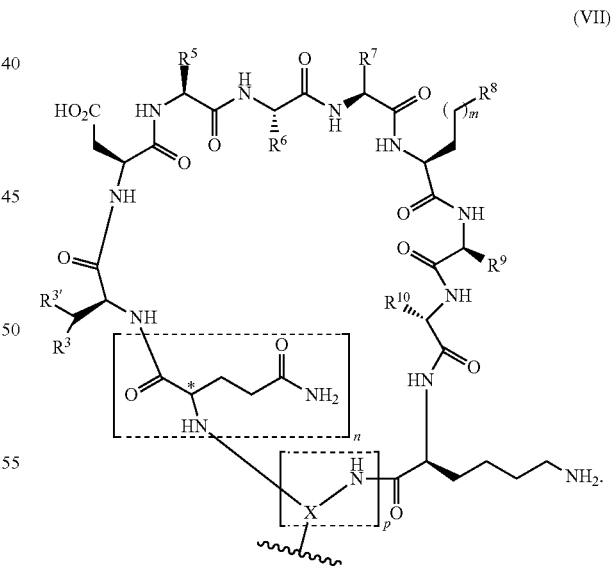

(VII)

The center marked with "*" is in the "R" or "S" configuration. The symbol § denotes the point of attachment of R$^{1A}$ to L$^{1A}$.

R$^3$ and R$^{3'}$ are each, independently, H or phenyl, optionally substituted with one, two, or three substituents independently selected from C$_{1-4}$alkyl, —OH, fluoro, chloro, bromo, and iodo.

$R^5$ is: (A) $C_{1-8}$alkyl, optionally substituted with one or more substituents selected from oxo, acetal, ketal, —B(OH)$_2$, boronic ester, phosphonate ester, ortho ester, —CO$_2$C$_{1-4}$alkyl, —CH=CH—CHO, —CH=CH—C(O)C$_{1-4}$alkyl, —CH=CH—CO$_2$C$_{1-4}$alkyl, —CO$_2$H, and —CONH$_2$; or (B) C$_{1-4}$alkyl substituted with: a) one or two phenyl groups, wherein each phenyl is optionally substituted with one, two, or three substituents independently selected from —OH, fluoro, chloro, bromo, and iodo; or b) a naphthyl, imidazole, or indole group.

$R^6$ is —C$_{1-4}$alkylene-OH or —C$_{1-4}$alkylene-SH. $R^7$ is —C$_{1-4}$alkylene-OH or —C$_{1-4}$alkylene-SH. The symbol m is 0, 1, 2, 3, 4, or 5.

$R^8$ is —OH, —NR$^a$R$^b$, —N(R$^c$)C(O)R$^e$, or —N(R$^c$)C(=NR$^d$)R$^e$. R$^a$ is H. R$^b$ is H or C$_{1-8}$alkyl optionally substituted with one or more substituents selected from oxo, acetal, and ketal, —B(OH)$_2$, —SH, boronic ester, phosphonate ester, ortho ester, —CH=CH—CHO, —CH=CH—C(O)C$_{1-4}$alkyl, —CH=CH—CO$_2$C$_{1-4}$alkyl, —CO$_2$H, or —CO$_2$C$_{1-4}$alkyl. R$^e$ is H, C$_{1-8}$alkyl, C$_{3-8}$cycloalkyl, branched alkyl, or aryl. R$^d$ is H or a C$_{1-8}$alkyl, C$_{2-8}$alkenyl, C$_{2-8}$alkynyl, C$_{3-8}$cycloalkyl, branched alkyl, or aryl, each optionally substituted with one or more substituents selected from —N$_3$, —NH$_2$, —OH, —SH, halogen, oxo, acetal, ketal, —B(OH)$_2$, boronic ester, phosphonate ester, ortho ester, —CH=CH—CHO, —CH=CH—C(O)C$_{1-4}$alkyl, —CH=CH—CO$_2$C$_{1-4}$alkyl, —CO$_2$H, and —CO$_2$C$_{1-4}$alkyl group. R$^e$ is H; —NHR$^d$; or a C$_{1-12}$alkyl, C$_{3-8}$cycloalkyl, C$_{2-12}$alkenyl, C$_{2-8}$alkynyl, or aryl group, each optionally substituted with one or more substituents selected from —N$_3$, —NH$_2$, —OH, —SH, oxo, C$_{2-4}$acetal, C$_{2-4}$ketal, —B(OH)$_2$, boronic ester, phosphonate ester, ortho ester, —CH=CH—CHO, —CH=CH—C(O)C$_{1-4}$alkyl, —CH=CH—CO$_2$C$_{1-4}$alkyl, and —CO$_2$C$_{1-4}$alkyl. Alternatively, R$^8$ is a C$_{1-12}$ alkyl substituted with an oxo, acetal, ketal, —B(OH)$_2$, boronic ester, —SH, —OH, phosphonate ester, ortho ester, —CH=CH—CHO, —CH=CH—C(O)C$_{1-4}$alkyl, —CH=CH—CO$_2$C$_{1-4}$alkyl, or —CO$_2$C$_{1-4}$alkyl.

$R^9$ is C$_{1-4}$alkyl or —C$_{1-2}$alkylene-R$^x$. R$^x$ is —CO$_2$H, —CONH$_2$, —CH$_2$NHC(O)NH$_2$, or —CH$_2$NHC(=NH)NH$_2$.

$R^{10}$ is: (1) C$_{1-8}$alkyl optionally substituted with one or more substituents selected from oxo, acetal, ketal, —B(OH)$_2$, boronic ester, phosphonate ester, ortho ester, —CH=CH—CHO, —CH=CH—C(O)C$_{1-4}$alkyl, —CH=CH—CO$_2$C$_{1-4}$alkyl, —CO$_2$C$_{1-4}$alkyl, —CO$_2$H, and —CONH$_2$; or (2) C$_{1-4}$alkyl group substituted with one or two phenyl groups, or one naphthyl, imidazole, or indole group, wherein each phenyl is optionally substituted with one, two, or three substituents independently selected from —OH, fluoro, chloro, bromo, and iodo;

The symbol n is 0 or 1. The symbol p is 0 or 1.

X is (1) a linker resulting from any of the meditope cyclization strategies discussed herein; (2) substituted alkylene, substituted heteroalkylene, substituted cycloalkylene, substituted heterocycloalkylene, substituted arylene or substituted heteroarylene or (3) C$_{1-8}$alkylene or C$_{2-8}$alkenylene, each carbon thereof optionally substituted with oxo, —C(O)—, —NH$_2$, —NHC(O)— or —NHC(O)R$^y$. One carbon of the X C$_{1-8}$alkylene is optionally replaced with —C(O)NH—, a 5-membered heteroaryl ring, or —S—S—. R$^y$ is —C$_{1-4}$alkyl or —CH(R$^z$)C(O)— or —CH(R$_z$)CO$_2$H. R$^z$ is —H or —C$_{1-4}$alkyl optionally substituted with —OH, —SH, or —NH$_2$. Formula VII includes all appropriate pharmaceutically acceptable salts. In (1), X is considered a substituted linker due to its chemical trivalency and because X may optionally include further substituents as set forth above (e.g. —NH$_2$ and oxo). In some embodiments, X is:

$$\text{(X)}$$

$$H_2N-CH-C(=O)- \\ | \\ CH_2 \\ | \\ S \\ | \\ S \\ | \\ H_2C \\ | \\ \{-C(=O)-CH-*$$

where  represents the point of attachment to the glutamine attached to X in Formula VII and * represents the point of attachment to the nitrogen attached to X and lysine in Formula VII. The symbol ⁅ denotes the point of attachment of X to the remainder of the molecule.

In some embodiments of the meditope of Formula VII, m is 0, 1, or 2. In other embodiments, $R^3$ is H or phenyl and $R^{3'}$ is phenyl, 2-bromophenyl, 3-bromophenyl, or 4-bromophenyl. In further embodiments, $R^5$ is methyl, ethyl, propyl, isopropyl, butyl, isobutyl, sec-butyl, or tert-butyl, each optionally substituted with an oxo, —B(OH)$_2$, —CO$_2$H, or —CONH$_2$ group, or with one or two phenyl groups each optionally substituted with a bromo or chloro substituent. In further embodiments, $R^8$ is —OH, —NH$_2$, —N(R$^c$)C(O)R$^e$, or —N(R$^c$)C(=NR$^d$)R$^e$. In still further embodiments, $R^d$ is H or methyl, R$^d$ is H or C$_{1-4}$alkyl, and R$^e$ is C$_{1-4}$alkyl, or —NH(C$_{1-4}$alkyl). In other embodiments, $R^9$ is methyl or ethyl, optionally substituted with —CO$_2$H, —CONH$_2$, —CH$_2$NHC(O)NH$_2$, or —CH$_2$NHC(=NH)NH$_2$. In still other embodiments, $R^{10}$ is methyl, ethyl, propyl, isopropyl, butyl, isobutyl, sec-butyl, or tert-butyl, each optionally substituted with an oxo, —B(OH)$_2$, —CO$_2$H, or —CONH$_2$ group. In still other embodiments, —X—NH— is -Cys-Cys- (e.g. bound through a disulfide bridge), -Gly-Gly-, —C(O)(CH$_2$)$_6$—NH—, -β-Ala-β-Ala-, —C(O)CH(NH$_2$)CH$_2$CH=CHCH$_2$CH(CO$_2$H)—NH—, —C(O)CH(NH$_2$)CH$_2$NHC(O)CH$_2$CH(CO$_2$H)—NH—, -β-Ala-C(O)CH$_2$CH(CO$_2$H)—NH—, or —C(O)CH(NH$_2$)CH$_2$-triazinyl-CH$_2$—CH(CO$_2$H)—NH—.

1. Modifications

Figure 2:
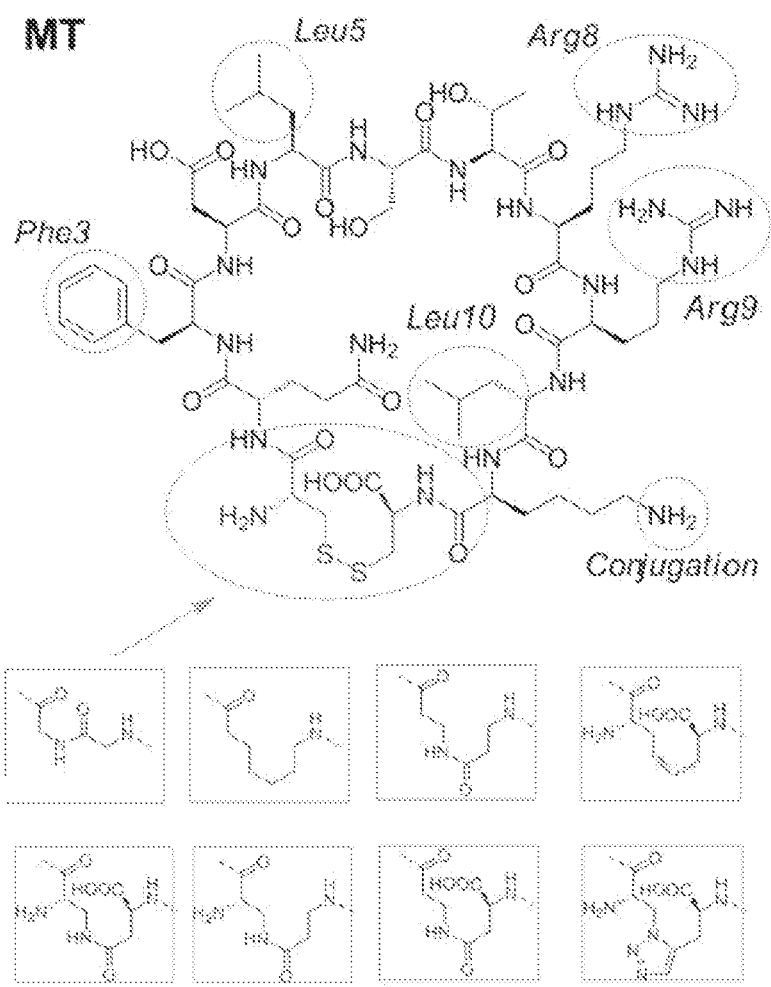
FIG. 2 shows the chemical structure of a meditope according to some embodiments. The circles indicate positions that can be modified, e.g., to improve meditope affinity for the Fab. The boxes indicate cyclization strategies. 'Click' chemistry and olefin metathesis, top and bottom far right boxes, respectively, are additional routes to cyclize the meditope.

Based on the structural and thermodynamic data, multiple positions within the meditopes 1 and 2 described herein have been identified as target sites for modification, e.g., with different natural or non-natural amino acids, to enhance the overall binding affinity and/or to alter another property as described herein. Such modifications include, but are not limited to, modification of cQFD or cQYN to generate a head-to-tail cyclic lactam peptide, modification of Arg8, modification of position 3 (e.g., Phe3 of cQFD or variant thereof), modification of Leu5, modification of Leu10, and/or incorporation of hydratable carbonyl functionality (see FIG. 2). As demonstrated herein, mutation of each of Phe3, Leu5, and Arg8 to alanine in the original meditope of cQFD reduced the affinity of the resulting compounds for the meditope-enabled antibody binding interface by 10-140-fold. In some aspects, the variant meditopes include those having modifications at one or more of position 1, 3, 5, 8, 10, and 12 of the meditope of SEQ ID NO: 1 or 2, or other meditope listed in Table 1 or 2.

a. Position 8

In some embodiments, the meditope variants contain a modification in the position corresponding to position 8 (Arg8) of meditope 1 or 2. In the unmodified meditope (cQFD; SEQ ID NO: 1), Arg8 is extended, making a hydrogen bond with the heavy chain carbonyl of Q105 of the meditope-enabled antibody heavy chain. The immediate area about this residue is hydrophobic yet solvent exposed. In some aspects, the meditopes contain a modified residue at this position (e.g., modified Arg8). In some examples, the modified residue maintains the iminium functionality of the Arg8 residue useful for meditope-enabled antibody H-bonding, and introduces a substituted or unsubstituted hydrophobic arm to fill the cavity. Such modifications result in significant gains in binding, due to entropic increases, as supported by ligand docking calculations. Such modifications may be incorporated by using an N-alkyl guanidinium group, or an alkyl-amidine functionality. In either case, the substituted group of the terminal N-atom can be alkyl or aryl, wherein each position of the alkyl or aryl group may be optionally substituted with additional functionalities within the group including the terminal position. In one example, a modified Arginine (modified Arg8), having a structure as shown in FIG. 1, is substituted for Arg8 of the meditope, e.g., of SEQ ID NO: 1 or 2 with the butyl group on the NH$_2$ (shown in FIG. 1 as NHR). In some aspects, the variant meditope contains an n-butyl-arginine or butylamidine modification at position 8.

b. Position 3

In some embodiments, the meditope variants contain a modification in the position corresponding to position 3, such as Phe3 of meditope 1. The hydroxyl group of the meditope variant Phe3Tyr cQYN (SEQ ID NO: 2) has an alteration in the extended conformation of the Arg8 side chain as compared to cQFD (SEQ ID NO: 1). Data herein suggest the formation of a favorable hydrogen bond network, with water bound to the Fab. Enthalpy-driven optimization has proven successful in many small-molecule approaches in drug design and there are opportunities in the provided meditopes for engineering increases in entropy. In some embodiments, approaches resulting in enthalpic and/or entropic gains in meditope designs are used to generate the variant meditopes, e.g., to optimize binding.

For example, when bound to a meditope-enabled antibody, the hydrophobic phenyl ring of Phe3 is surrounded by a fairly polar array of side chain residues of the meditope-enabled antibody Fab. In some embodiments, one or more halogens is introduced on the phenyl ring of this residue, to allow for a halogen bonding interaction with the polar side chain residues. A halogen bond is a relatively strong non-covalent bond, similar to a hydrogen bond but involving the interaction of a halogen such as bromine or chlorine (or other halogen), with an oxygen atom. In some aspects, the residue at this position is modified to incorporate a halogen substituent. In some aspects, Phe3 is replaced with 2-bromo-, 3-bromo-, or 4-bromophenylalanine, in order to place a bromine atom in a position suitable for halogen bonding with a meditope-enabled antibody, e.g., at positions Tyr87 (light chain), Gln38, and/or Tyr91 (heavy chain) of a meditope-enabled antibody, respectively. Such phenylalanine derivatives are commercially available and in some aspects are incorporated into the cyclic peptide meditope variant by solid phase peptide synthesis (SPPS). Exemplary variant meditopes include those containing 2-bromo-L-phenylalanine, 3-bromo-L-phenylalanine, or 4-bromo-L-phenylalanine in the position corresponding to Phe3 of meditope 1.

In another example, the meditope incorporates an additional phenyl group at this position, for example, by replacing Phe3 with β,β'-diphenylalanine.

c. Positions 5 and 10 (e.g., Leu5, Leu10 of Meditopes 1 or 2)

In some embodiments, the meditope variants contain a modification in the position corresponding to position 5 or 10 (Leu5 or Leu10) of meditopes 1 or 2. As shown herein, the side chains of Leu5 and Leu10 of meditope 1 make hydrophobic contacts to the meditope-enabled Fab. In certain embodiments, one or more properties of the meditopes, e.g., affinity, are altered by incorporating a different natural amino acid, or a non-natural amino acid at one or both of these positions, e.g., thereby changing the amount of surface area that can be extended. In one embodiment, natural amino acids (Phe/Tyr/Trp) and non-natural analogs (e.g., β,β'-diphenyl-L-alanine, or amino acids incorporating side chains that include branched alkyl, extended aromatics such as napthyl, or other hydrophobic groups) are systematically introduced via SPPS at one or both positions.

2. Conjugation

In certain embodiments, the meditope is conjugated to an agent, such as a therapeutic agent, a diagnostic agent, or a detectable agent. The peptide can be conjugated to the agent via any suitable means, such as via a chemical linker. In certain embodiments, the chemical linker is a covalent linker. In embodiments, the chemical linker comprises a substituted or unsubstituted alkylene, substituted or unsubstituted heteroalkylene, substituted or unsubstituted cycloalkylene, substituted or unsubstituted heterocycloalkylene, substituted or unsubstituted arylene and/or substituted or unsubstituted heteroarylene.

In certain embodiments, the chemical linker comprises a PEG linker. In certain embodiments, the chemical linker comprises a peptide linker (e.g., one or more natural or unnatural amino acids, such as glycine, lysine, tyrosine, glutamic acid, aspartic acid, etc.).

The chemical linker can be bonded to the meditope at any suitable location, such as the N-terminus, the C-terminus, and/or off a side chain. In certain embodiments, the chemical linker is bonded to the N-terminus. In another embodiment, the chemical linker is bonded to the C-terminus. In still another embodiment, the meditope comprises more than one chemical linker, where the chemical linkers are bonded to the N-terminus and the C-terminus. In some embodiments, the chemical linker comprises the amino acid sequence—GGGK.

In certain embodiments disclosed herein, the chemical linker may further comprise a commercially available linker known in the art for forming antibody-drug conjugates. Accordingly, in certain embodiments, the chemical linker may comprise a linker selected from the group consisting of Ala-Ala-Asn-PAB, ALD-BZ-OSu, ALD-di-EG-OPFP, ALD-di-EG-OSu, ALD-mono-EG-OPFP, ALD-mono-EG-OSu, ALD-tetra-EG-OPFP, ALD-tetra-EG-OSu, ALD-tri-EG-OPFP, ALD-tri-EG-OSu, BCOT-di-EG-OPFP, BCOT-di-EG-Osu, BCOT-tetra-EG-OPFP, BCOT-tetra-EG-OSu, BCOT-tri-EG-OPFP, BCOT-tri-EG-Osu, Boc-NMe-DAE, BrAH, Br-di-EG-OSu, Br-tetra-EG-OSu, Br-tri-EG-OSu, COT-acetic acid, COT-di-EG-OPFP, COT-di-EG-OSu, COT-tetra-EG-OPFP, COT-tetra-EG-OSu, COT-tri-EG-OPFP, COT-tri-EG-OSu, DHA, DHH, Fmoc-Ala-Ala-Asn-PAB-PNP, Fmoc-Phe-Lys(Trt)-PAB-PNP, Fmoc-Val-Cit-PAB, Fmoc-Val-Cit-PAB-PNP, HAC, MAH, MAL-di-EG- OPFP, MAL-di-EG-OSu, MAL-HA-OSu, MAL-tetra-EG-OPFP, MAL-tetra-EG-OSu, MAL-tri-EG-OPFP, MAL-tri-EG-OSu, MBA, MC-Val-Cit-PAB-PNP, MDB, MEL-di-EG-OPFP, MEL-di-EG-OSu, MEL-tetra-EG-OPFP, MEL-tetra-EG-OSu, MEL-tri-EG-OPFP, MEL-tri-EG-OSu, MMC, N3BA, N3-di-EG-OPFP, N3-di-EG-OSu, N3-tetra-EG-OPFP, N3-tetra-EG-OSu, N3-tri-EG-OPFP, N3-tri-EG-OSu, PAB, PHA-di-EG-OPFP, PHA-di-EG-OSu, PHA-tetra-EG-OPFP, PHA-tetra-EG-OSu, PHA-tri-EG-OPFP, PHA-tri-EG-OSu, Phe-Lys(Fmoc)-PAB, Phe-Lys(Trt)-PAB, Py-ds-But-OPFP, Py-ds-But-OSu, Py-ds-dmBut-OPFP, Py-ds-dmBut-OSu, Py-ds-Prp-OPFP, Py-ds-Prp-OSu, and Val-Cit-PAB (ALB Materials Inc, Nevada, U.S.).

Non-limiting examples of conjugated meditope peptides are shown in the table below.

phenylalanine residue), (ii) thiol reactive by incorporating phenylselenidylalanine, (iii) a UV crosslinker containing benzophenone by incorporating p-benzoyl-L-phenylalanine, (iv) amine reactive by incorporating p-isopropylthiocarbonyl-phenylalanine or p-ethylthiocarbonyl-phenylalanine, (v) heterocyclic linkages, such as a triazine, thiazole, thiazolidine, or oxazole linkage, made, for example, by reaction of a residue containing an azide group with a residue containing an alkyne group via Huisgen cycloaddition (e.g., reaction of a p-propargyloxyphenylalanine residue with a p-azidophenylalanine residue); (v) an amide bond made by reaction of an acid group in one residue with an amine group in another residue; (vi) an ester bond made by reaction of an acid group in one residue with an alcohol in another residue, such as a serine; (vii) a double bond, made by reaction of

| NAME | Description |
| --- | --- |
| DM1-MCC-cQFD (048-004) | Ac-CQFDLSTRRLRCGGGK-OH (SEQ ID NO: 307); C:C = disulfide-DM1 |
| MMAD-PAB-cv-Glu-cQFD (048-002) | Ac-CQFDLSTRRLRCGGGK-OH (SEQ ID NO: 307); C:C = disulfide-MMAD |
| DM1-MCC-cQFD-Di-Ph-Ala (048-003) | Ac-CQFDXSTRRLRCGGGK (SEQ ID NO: 308); C:C = Disulfide; X = β,β-diphenyl-Ala-DM1 |
| MMAD-PAB-cv-Glu-cQFD-Di-Ph-Ala (048-001) | Ac-CQFDXSTRRLRCGGGK (SEQ ID NO: 308); C:C = Disulfide; X = β,β-diphenyl-Ala-MMAD |
| MMAD-PAB-cv-Glu-MB-002-203 | MMAD conjugated photoactivatable long cQFD photo-Met 10; 1505048089 |
| MMAD-PAB-cv-Glu-MB-002-204 | MMAD conjugated photoactivatable long cQFD photo-Met 9; 1505048087 |
| MMAD-PAB-cv-Glu-MB-002-205 | MMAD conjugated photoactivatable long cQFD photo-Met 8; 1505048088 |
| MMAD-cv-PAB-MB-002-206 | MMAD conjugated photoactivatable long cQFD azido-Phe 6; 1509048150 |
| MMAD-cv-PAB-MB-002-208 | MMAD conjugated photoactivatable long cQFD azido-Phe 3; |
| MMAD-cv-PAB-MB-002-209 | MMAD conjugated photoactivatable long cQFD azido-Phe 10; |
| MMAD-cv-PAB-MB-002-210 | MMAD conjugated photoactivatable long cQFD benzoyl-Phe 3; |
| MMAD-cv-PAB-MB-002-211 | MMAD conjugated photoactivatable long cQFD benzolyl-Phe 10; |
| Ac-CQFDLSTRRXRCGGGK-MCC-DM1 | DM1 conjugated photoactivatable long cQFD photo-Met 10 |
| Ac-CQFDLSTRRXRCGGGK-PEG4-vc-PAB-duocarmycin SA | Duocarmycin SA conjugated photoactivatable long cQFD photo-Met 10 |
| Ac-CQFDLSTRRXRCGGGK-Glu-Val-Ala-PAB-PBD | PBD conjugated photoactivatable long cQFD photo-Met 10 |
| Ac-CQFDLSTRRXRCGGGK-linker-alpha-Amanitin | Amanitin conjugated photoactivatable long cQFD photo-Met 10 |

MMAD: Monomethyl auristatin D

3. Alternative Cyclization Strategies and Replacement of Disulfide Bridge

In certain embodiments, the variant meditopes include a disulfide bridge, as in cQFD and cQYN. Disulfide bridges may be formed by the reaction of the side chains of two cysteine residues. In certain embodiments, the disulfide bridge in a meditope, e.g., meditope 1 or 2, is replaced with an alternative linkage or is removed. Thus, among the variant meditopes are those having alternative linkages or lacking the disulfide bridge of the original meditopes.

In some aspects, the linkage is made between one or more unnatural amino acids within the amino acid chain. Examples of linkages that may be made with unnatural amino acids include linkages comprising (i) stable hydrazone or oxime-based linkages made by reaction of a residue comprising an aldehyde or ketone with a residue comprising an amine group, where the amine nitrogen is substituted with —NH₂ or alkyloxy group (e.g., reaction of a p-acetylphenylalanine, m-acetylphenylalanine, or p-(3-oxobutanoyl)-L-phenylalanine residue with a p-(2-amino-3-hydroxyethyl)- two residues each containing a terminal olefin, e.g., by olefin metathesis (e.g., reaction of two allylglycine residues or two N-allyl substituted amino acids), or (viii) by reaction of any other pair of suitable residues known in the art. For a review, see, for example, Davies, J. S., "The Cyclization of Peptides and Depsipeptides," *J. Peptide Sci.* 2003, 9, 471-501. In one embodiment, the meditope may direct a reactive group to an unnatural amino acid incorporated into the Fab, such as p-acetylphenylalanine.

Various methods for cyclization of a meditope may be used, e.g., to address in vivo stability and to enable chemoselective control for subsequent conjugation chemistry. In some embodiments, the cyclization strategy is a lactam cyclization strategy, including head-to-tail (head-tail) lactam cyclization (between the terminal residues of the acyclic peptide) and/or lactam linkage between other residues. Lactam formation may also be effected by incorporating residues such as glycine, β-Ala, 7-aminoheptanoic acid, and the like, into the acyclic meditope cyclization precursors to produce different lactam ring sizes and modes of connectivity. Additional cyclization strategies such as "click" chemistry and olefin metathesis also can be used (see FIG. 2, right boxes). Such methods of peptide and peptidomimetic cyclization are well known in the art.

In some embodiments, the meditopes containing lactam linkages are more stable, in vivo, e.g., have a linkage that is more stable in vivo compared to meditopes with other linkages.

In some embodiments, the terminal residues of an acyclic peptide are reacted to form a cyclic meditope, e.g., cyclic meditope variant. In other embodiments, other positions are amenable to cyclization, including between residues 3 and 11 and 4 and 11. Thus, in some aspects, the meditopes contain a linkage formed between residues other than the N-terminal and C-terminal residues, such as between residues 3 and 11 and/or 4 and 11, e.g., of a 12-amino acid peptide.

Figure 3:
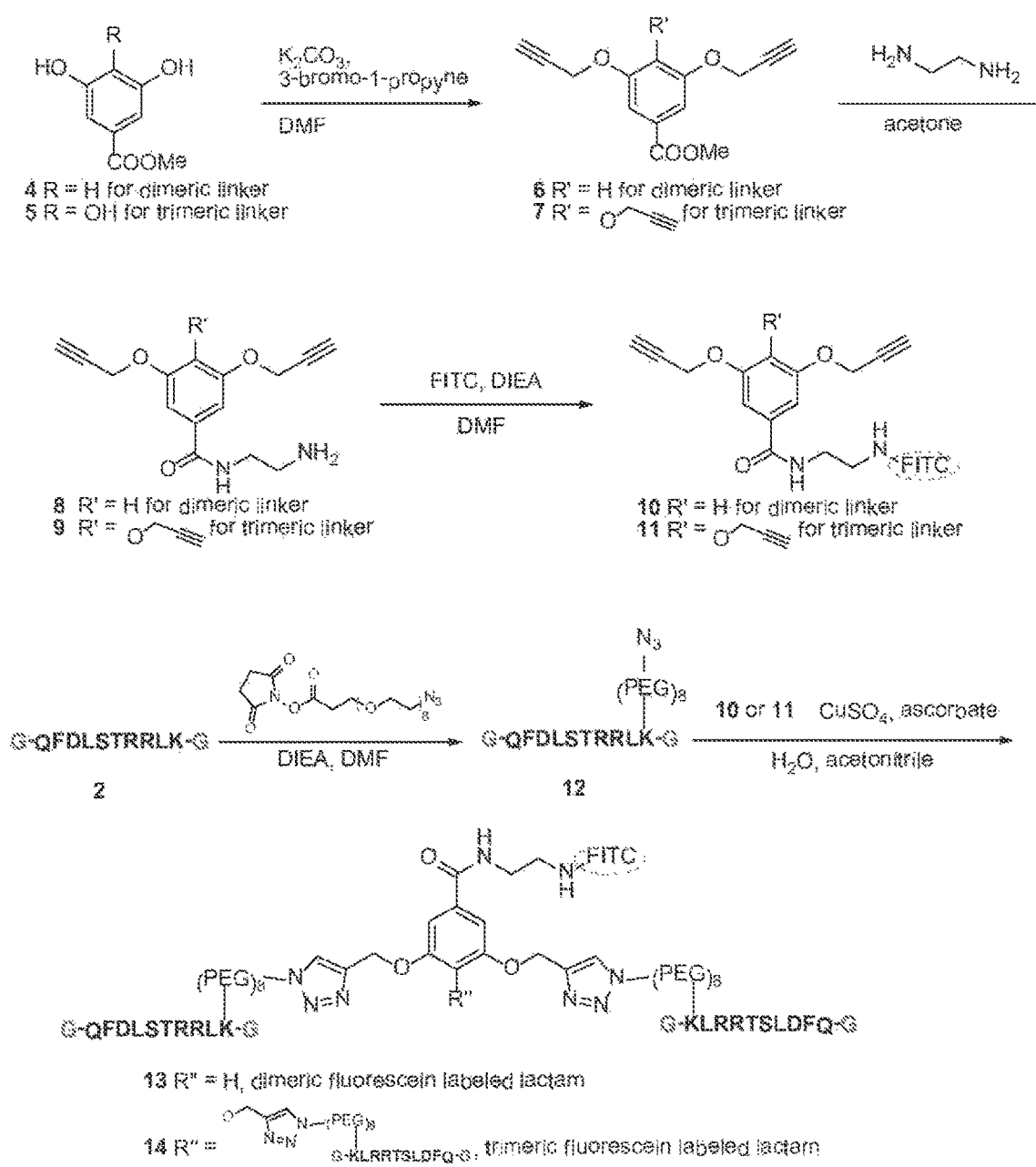
FIG. 3 shows a procedure for conjugation of a meditope variant with fluorescein for FACS analysis. The figure illustrates the synthesis of dimeric and trimeric meditopes according to some embodiments, for meditopes containing lactam linkages. Sequence legend: (GQFDLSTRRLKG) SEQ ID NO:173; (GKLRRTSLDFQG) SEQ ID NO:174.

In some embodiments, the meditopes, e.g., variant meditopes, contain a reactive amine functionality (e.g., Lys11), which can be used for subsequent conjugation of the meditope variant, e.g., to a scaffold or linker or to an agent, such as a diagnostic, e.g., imaging, agent or therapeutic agent as described herein. For example, FIG. 3 shows a procedure for conjugation of a meditope variant with fluorescein for FACS analysis; this strategy can be applied to other imaging and other agents, including DOTA for in vivo PET imaging.

C. Meditope Enabled Antibodies

Provided are meditope-enabled antibodies and antigen binding fragments thereof that are capable of binding to one or more meditopes via meditope-binding sites. In some cases, the meditope-enabled antibody binds to a cyclic peptide of SEQ ID NO: 1 or 2 (meditope 1 or 2) and/or to one or more variants thereof, such as meditopes 1, 2, 16-18, 23, 29, 31, 32, 36, 39, 42, 43, 45, 46, 51, 52, 54, or 55 (meditopes based on peptides having the sequences set forth in SEQ ID NOS: 1, 2, 16-18, 23, 29, 31, 32, 36, 39, 42, 43, 45, 46, 51, 52, 54, or 55), or in some cases, any of meditopes 1, 2, or 15-55 and/or meditopes of any of SEQ ID NOS: 186-190 and 207. Among the provided meditope-enabled antibodies are those that bind to a meditope or meditopes with an affinity similar to that of cetuximab. For example, in certain aspects, the antibodies bind to the meditope(s) with a dissociation constant of less than at or about 10 µM, less than at or about 5 µM, or less than at or about 2 µM, less than at or about 1 µM, less than at or about 500, 400, 300, 200, 100 nM, or less, such as at or about 200 picomolar or less. In some cases, the dissociation constant, such as any of those listed herein, is that measured using a particular technique, such as surface plasmon resonance (SPR), isothermal titration calorimetry (ITC), fluorescence, fluorescence polarization, NMR, IR, calorimetry titrations; kinetic exclusion; circular dichroism, differential scanning calorimetry, or other known method. For example, in some cases, the analog or meditope exhibits a binding constant of less than at or about 10 µM, less than at or about 5 µM, or less than at or about 2 µM, less than at or about 1 µM, less than at or about 500, 400, 300, 200, 100 nm, or less, as measured by SPR or as measured by ITC or as measured by any of these methods.

Figure 4A:
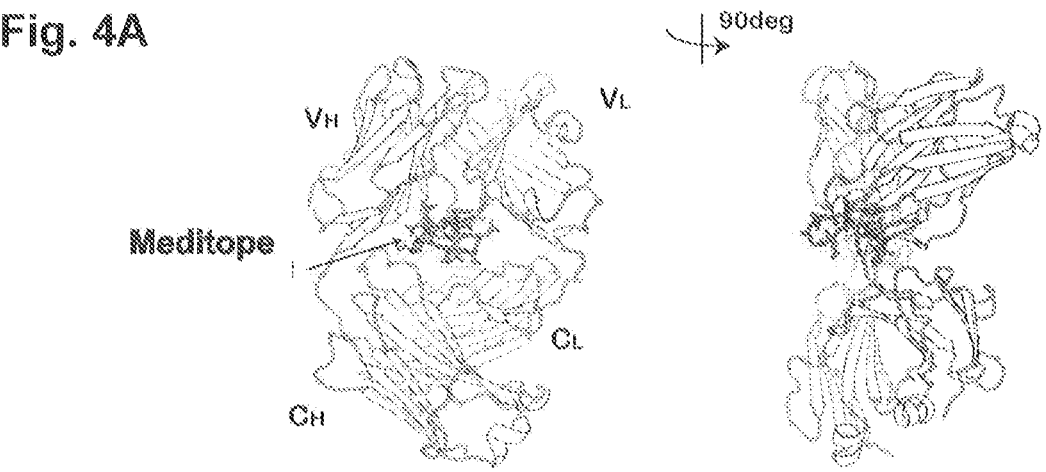
FIG. 4A shows meditope peptides binding to framework loops of cetuximab. The complex of cetuximab Fab (light chain is denoted by VL and CL; heavy chain is denoted by VH and CH) and cyclic CQFDLSTRRLKC (depicted within the shaded area and labeled with the word "meditope") (SEQ ID NO: 1) indicates that the meditope binds to an interface of the Fab framework, which is distinct from the CDR loops of cetuximab.
Figure 4B:
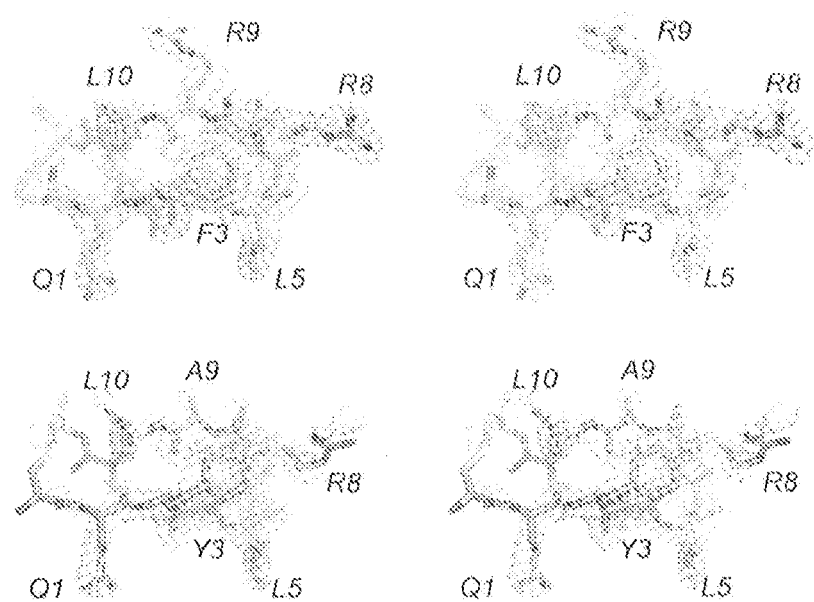
FIG. 4B (top) shows the stick representation of the cQFD meditope and (bottom) the stick representation of the cQYN meditope. The N- and C-terminal cysteines are solvent exposed and display high thermal factors.
Figure 5:
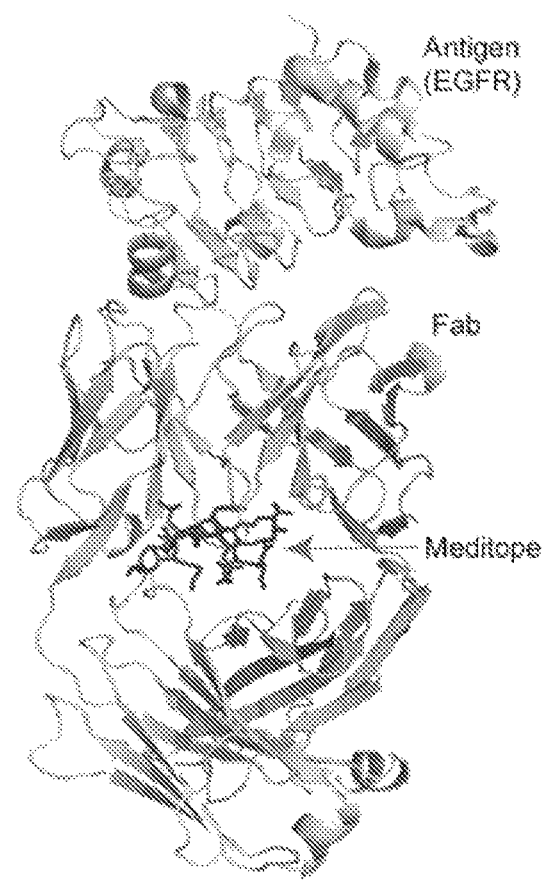
FIG. 5 illustrate that the cQFD and cQYN meditopes do not bind to the CDRs of cetuximab, as was previously hypothesized. The figure shows an overlay of two crystal structures, one of a cetuximab Fab and its epitope, EGFR domain III, the other showing the cQFD meditope and cetuximab Fab, in which the cQFD meditope binds to the central cavity of the cetuximab Fab. The antigen, EGFR domain III, binds at the complementarity determining regions at a significant distance from the meditope binding site.
Figure 6:
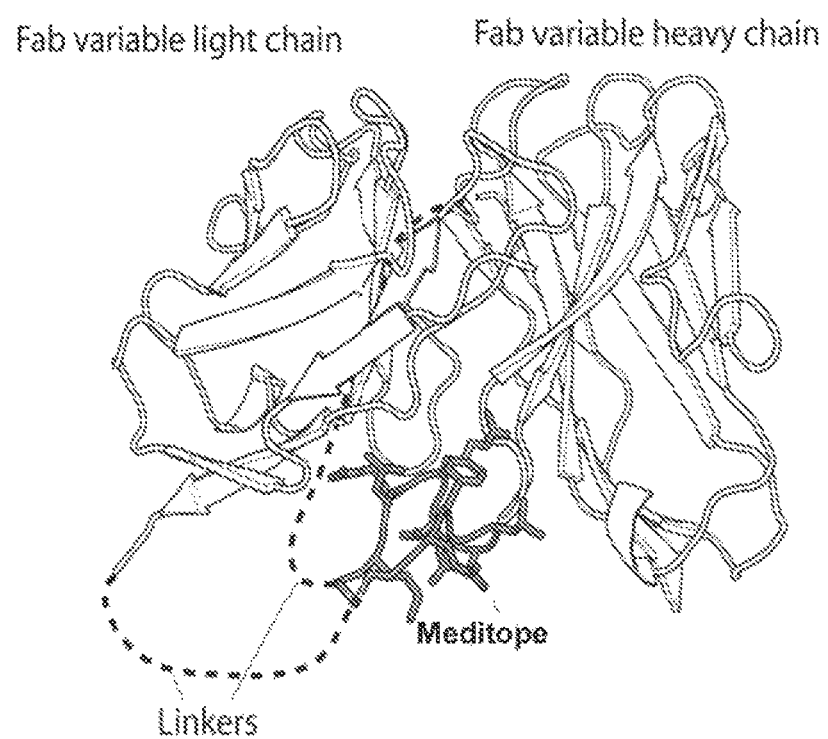
FIG. 6 shows an scFv-meditope linker. scFvs are created by fusing the light chain variable domain to the heavy chain variable domain (or vice versa) through a 12-20 amino acid linker (typically {GGGS}3-5). In this example, a portion of the flexible linker sequence can be replaced with the meditope sequence.

In some examples, the meditope-binding site is a structural feature of the monoclonal antibody cetuximab. Thus, in some cases, the meditope-binding site contains residues corresponding to those within the meditope binding site of cetuximab. X-ray crystallographic analysis has revealed that the peptides of SEQ ID NO: 1 binds to a meditope-binding site within the central cavity of the cetuximab Fab fragment, defined by various residues of the heavy and light chains (see FIGS. 4A and 5), with a binding constant of ~700 nM.

In certain embodiments, the unique interactions between the meditopes and the meditope binding site are exploited to generate additional meditope-enabled antibodies. In some embodiments, the meditope-enabled antibodies are generated by modifying cetuximab or an antibody other than cetuximab (sometimes referred to as the template antibody), such as an antibody having one or more CDRs distinct from those of cetuximab, to confer the ability to bind to one or more of the provided meditopes, such as a meditope of SEQ ID NO: 1 or 2, or variant thereof.

The template antibody can be a human or humanized antibody or a mouse antibody. In one aspect, the modifications include substituting residues within the central cavity of the Fab fragment, typically within the framework regions (FRs) of the heavy and light chain variable regions and/or the constant regions to render the template antibody meditope-enabled. For example, where the template antibody is a human or humanized antibody, the modifications generally include substitutions at residues within the heavy and light chain variable region FRs. In some embodiments, such residues are replaced with the corresponding residue present in cetuximab, or comparable amino acid. Thus, in certain embodiments, residues within the FRs of a human or humanized antibody are replaced with corresponding murine residues; in certain embodiments, they are replaced by other residues, such as those having similar functional groups or moieties for interacting with the meditopes. Typically, the residues replaced by corresponding murine (or other) residues are found within the central Fab cavity, and thus are not exposed to the immune system. As such, in some embodiments, introducing these amino acid substitutions in a human or humanized antibody do not increase or do not substantially increase the antigenicity of the modified template antibody, in the context of delivery to a human subject. In addition, antigenicity prediction algorithms may be further used to indicate that the human sequence with the point mutations should not be antigenic.

In some embodiments one or more residues that are replaced in a meditope binding site are selected to give a self-crosslinking antibody a specific binding affinity for a specific meditope, which can be a free meditope, a meditope bound to an antibody via a linker, or both. For example, some embodiments of a self-crosslinking antibody comprise meditope binding sites that exhibit high or increased affinity for a first meditope and low or reduced affinity for a second meditope. In some embodiments, the first meditope is a free meditope and the second meditope is attached to a self-crosslinking antibody via a linker, as described herein. Such embodiments can be advantageous, for example, when free meditope is used to control or modulate antibody self-crosslinking, as described herein. In other embodiments, the first meditope is attached to a self-crosslinking antibody via a linker, and the second meditope is a free meditope. Such embodiments can be advantageous, for example, when high concentrations of free meditope are used and/or when antigen levels or concentrations are low or reduced.

In some embodiments, the one or more residues that are replaced, are selected from light chain framework residues 10, 39-43, 45, 83, 85, 100 and/or 104, according to Kabat numbering (see Kabat E. A., et al. (1991) Sequences of Proteins of Immunological Interest, Fifth Edition. NIH Publication No. 91-3242, incorporated herein by reference in its entirety), and/or heavy chain framework residue numbers 40, 89 and/or 105, according to Kabat numbering. In general, unless otherwise specified, amino acid positions in the heavy or light chain of an antibody refer to Kabat numbering. Also encompassed within the present disclosure are residues in other antibodies corresponding to the residues of cetuximab described herein, such as those within the cetuximab meditope-binding site. In some embodiments, residues in the template antibody corresponding to light chain residues 9, 10, 39, 40, 41, 42, 43, 45, 83, 85, 100, and/or 104, and/or heavy chain residues 40, 89, and/or 105, are replaced, for example, with amino acids present at those positions within cetuximab. In some embodiments, the meditope-enabled antibody contains, within its light chain framework regions (or within one or more such FRs, e.g., FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of the template antibody; and/or contains, within its heavy chain framework regions (or within one or more such FRs, e.g., FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H(s)) of the template antibody; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of the template antibody; and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL regions of the template antibody. In some embodiments, the antibody contains all or at least 95, 96, 97, 98, or 99% identity within one or more, e.g., all, of the CDRs within the heavy and/or light chain, compared to the template antibody. In some aspects, the antibody contains 1, 2, 3, 4, 5, 6, 7, 8, 9, 10, 11, 12, 13, 14, 15, 16, 17, 18, 19, or 20 modifications within the light chain (e.g., FR-Ls) compared to the template antibody and/or contains 1, 2, 3, 4, 5, 6, 7, 8, 9, 10, 11, 12, 13, 14, 15, 16, 17, 18, 19, or 20 modifications within the heavy chain (e.g., FR-Hs) compared to the template antibody.

In one embodiment, the one or more residues replaced are light chain framework residues including, but not limited to, 10, 40, 41, 83 and 85, according to Kabat numbering. In one embodiment, light chain residue 40 is replaced with threonine; light chain residue 41 is replaced with asparagine, light chain residue 83 is replaced with isoleucine or valine, and/or light chain residue 85 is replaced with aspartate. In one embodiment, light chain residue 40 is replaced with threonine; light chain residue 41 is replaced with asparagine, light chain residue 83 is replaced with glutamate, and/or light chain residue 85 is replaced with aspartate. In a particular example, light chain framework Pro40 is replaced with Thr (P40T) or Ser (P40S), light chain framework Gly41 is replaced with Asn (G41N), light chain framework residue Phe83 is replaced with Ile (F83I) or Val (F83V) or glutamate (F83E) and light chain framework residue Thr85 is replaced with Asp (T85D) or Asn (T85N). In some embodiments, including, for example, cetuximab, light chain framework residue Ile83 is replaced with glutamate (I83E).

Thus, among the provided meditope-enabled antibodies are antibodies having one or more modifications, typically amino acid substitutions, at residues that correspond to positions within the meditope binding site of cetuximab or other meditope-enabled antibody, such as those described herein, including meditope-enabled trastuzumab and meditope-enabled MSA. Among the antibodies are those having a VL region with a threonine, serine, or aspartate at position 40, a residue other than glycine at position 41, and an aspartate or asparagine at position 85, according to Kabat numbering, for example, an antibody with a VL region having a threonine at position 40, an asparagine at position 41, and an aspartate at position 85. In some embodiments, the antibody has a VH region with a serine at position 40 and an isoleucine at position 89 and/or a VH region with a serine or proline at position 40 and an isoleucine, tyrosine, methionine, phenylalanine, or tryptophan at position 89, according to Kabat numbering. In some embodiments, the VL region has an isoleucine or leucine at position 10, and/or an isoleucine at position 83 or a glutamate at position 83. In some embodiments, the VL region has a valine or isoleucine at position 9 and/or a residue other than glutamine at position 100.

In some examples, the VL region has a valine or isoleucine at position 9, an isoleucine or leucine at position 10, an arginine at position 39, a threonine at position 40, an asparagine at position 41, a glycine at position 42, a serine at position 43, an isoleucine or glutamate at position 83, an aspartate at position 85, and an alanine at position 100; and the VH region has a serine at position 40 and an isoleucine at position 89, according to Kabat numbering. In some examples, the VL region does not contain a proline at position 40, a glycine at position 41, or a threonine at position 85, according to Kabat numbering, and/or the VH region does not contain an asparagine or alanine at position 40 or a valine at position 89, according to Kabat numbering. In some examples, the VL region does not contain an serine at position 10, a proline at position 40, a glycine at position 41, an phenylalanine at position 83, or a threonine at position 85, according to Kabat numbering, and/or the VH region does not contain an asparagine or alanine at position 40 or a valine at position 89, according to Kabat numbering.

In some aspects, the antibody has a light chain having P8, V9 or I9, I10 or L10, Q38, R39, T40, N41 G42, S43, P44, R45, D82, I83, A84, D85, Y86, Y87, G99, A100, G101, T102, K103, L104, E105, R142, S162, V163, T164, E165, Q166, D167, S168, and Y173, according to Kabat numbering, and/or a heavy chain having Q6, P9, R38, Q39, S40, P41, G42, K43, G44, L45, S84, D86, T87, A88, I89, Y90, Y91, W103, G104, Q105, G106, T107, L108, V109, T110, V111, Y147, E150, P151, V152, T173, F174, P175, A176, V177, Y185, S186, and L187, according to Kabat numbering.

In some aspects, the antibody has a light chain having P8, V9 or I9, I10 or L10, Q38, R39, T40, N41 G42, S43, P44, R45, D82, E83, A84, D85, Y86, Y87, G99, A100, G101, T102, K103, L104, E105, R142, S162, V163, T164, E165, Q166, D167, S168, and Y173, according to Kabat numbering, and/or a heavy chain having Q6, P9, R38, Q39, S40, P41, G42, K43, G44, L45, S84, D86, T87, A88, I89, Y90, Y91, W103, G104, Q105, G106, T107, L108, V109, T110, V111, Y147, E150, P151, V152, T173, F174, P175, A176, V177, Y185, S186, and L187, according to Kabat numbering.

In some embodiments, the meditope-enabled antibody is generated by mutating 1, 2, 3, 4, 5, 6, 7, 8, 9, 10, or 11 residues in the light chain of an antibody, such as a human or humanized antibody, e.g., trastuzumab, for example, to resemble the corresponding positions in cetuximab (based on Kabat numbering). In some aspects, such an antibody contains mutated residues at positions 9, 10, 39, 40, 41, 42, 43, 45, 83, 85, and 100 of the light chain, based on Kabat numbering, compared to the human or humanized sequence. In one aspect, the light chain of the meditope-enabled antibody contains: V9 or I9, I10 or L10, R39, T40, N41 G42, S43, R45, I83 or E83, D85, and A100, e.g.: V9, I10, R39, T40, N41, G42, S43, R45, I83, D85, and A100, based on Kabat numbering. In some embodiments, the antibody is otherwise human or humanized.

In some embodiments, the meditope-enabled antibody is generated by mutating 1, 2, 3, 4, 5, 6, 7, 8, 9, 10, or 11 residues such as 1 or 2 residues in the heavy chain of an antibody, such as a human or humanized antibody, e.g., trastuzumab, for example, to resemble the corresponding positions in cetuximab. In some aspects, such an antibody contains mutated residues at positions 40 and 89 in the heavy chain, based on Kabat numbering, compared to the human or humanized sequence. In one aspect, the heavy chain contains S40 and I89, based on Kabat numbering. In some embodiments, the antibody is otherwise human or humanized.

In some embodiments the meditope-enabled antibody contains 13 mutations, e.g., compared to the humanized or human sequence. In one aspect, the meditope-enabled antibody contains a light chain having 11 mutations and a heavy chain having two mutations, compared to the humanized or human sequence. In some aspects, the antibody contains V9 or 19, I10 or L10, R39, T40, N41 G42, S43, R45, I83, D85, and A100 in the light chain and S40 and I89 in the heavy chain, based on Kabat numbering. In some aspects, the antibody contains V9 or 19, I10 or L10, R39, T40, N41 G42, S43, R45, E83, D85, and A100 in the light chain and S40 and I89 in the heavy chain, based on Kabat numbering. In some aspects, the antibody contains V9, I10, R39, T40, N41 G42, S43, R45, I83, D85, and A100 in the light chain and S40 and I89 in the heavy chain, based on Kabat numbering. In some aspects, the antibody contains V9, I10, R39, T40, N41 G42, S43, R45, E83, D85, and A100 in the light chain and S40 and I89 in the heavy chain, based on Kabat numbering. In some embodiments, the antibody and/or the framework regions thereof is or are otherwise human or humanized.

In other embodiments, the meditope-enabled antibodies are generated via CDR grafting, typically by modifying one or more complementarity determining region (CDR) (e.g., one or more of CDRs 1-3) of the heavy and/or light chain of a meditope-enabled antibody, such as any of the meditope-enabled antibodies described herein, to replace them with other CDRs, such as CDRs of existing or new antibodies. CDR grafting is standard practice for producing humanized monoclonal antibodies, e.g., by grafting CDRs of an antibody generated in a non-human species, such as mouse, onto a human antibody framework. See U.S. Pat. Nos. 5,558,864 and 8,133,982; Kettleborough et al., "Humanization of a mouse monoclonal antibody by CDR-grafting: the importance of framework residues on loop conformation," Protein Eng., 4:773-783 (1991). Thus, in certain embodiments, the antigen specificity of a meditope-enabled antibody is altered by grafting the CDRs of preexisting or newly-generated antibodies of interest. Also among the provided meditope-enabled antibodies are such CDR-grafted meditope-enabled antibodies.

In some embodiments, the meditope-enabled antibodies are generated, using one of the antibodies disclosed herein (e.g., cetuximab, meditope-enabled trastuzumab, or meditope-enabled M5A (anti-CEA) antibody) as a template sequence, and carrying out one or more known antibody engineering methods to alter it, for example, to alter its antigen-binding characteristics, producing a meditope-enabled antibody with distinct characteristics. Known antibody engineering methods typically employed to alter antigen binding and other properties include various in vitro randomization, affinity maturation, and selection methods, including error-prone PCR, spiked PCR, site-directed mutagenesis, phage display and other selection methods. Also provided are constructs, libraries, and expression systems, including GPI-linked expression systems, for carrying out such methods. Thus, in certain embodiments, the provided meditope-enabled antibody has a light chain and/or heavy chain variable region with the framework region or regions (FRs) of a meditope-enabled antibody, such as cetuximab, a meditope-enabled trastuzumab, or a meditope-enabled M5A (or FR(s) with at least at or about 75, 80, 85, 90, 91, 92, 93, 94, 95, 96, 97, 98, or 99% identity to the FR(s) of such an antibody). In some aspects, such an antibody has one or more CDRs that are distinct from the CDRs of that meditope-enabled antibody.

For example, in some embodiments, the VL region has an amino acid sequence comprising a light chain framework region (FR) 1 (FR-L1), an FR-L2, an FR-L3, and/or an FR-L4 of the light chain sequence set forth in SEQ ID NO: 71 (or an FR-L1, FR-L2, FR-L3, and/or FR-L4 that is at least at or about 75, 80, 85, 90, 91, 92, 93, 94, 95, 96, 97, 98, or 99% identical to the FR-L1, FR-L2, FR-L3, and/or FR-L4 of SEQ ID NO: 71), and in some aspects at least one CDR that is distinct from the CDRs of the light chain sequence set forth in SEQ ID NO: 71; and/or a VH region with an amino acid sequence having a heavy chain FR1 (FR-H1), an FR-H2, an FR-H3, and/or an FR-H4, of the heavy chain sequence set forth in SEQ ID NO: 72 (or an FR-H1, FR-H2, FR-H3, and/or FR-H4 that is at least at or about 75, 80, 85, 90, 91, 92, 93, 94, 95, 96, 97, 98, or 99% identical to the FR-H1, FR-H2, FR-H3, and/or FR-H4 of SEQ ID NO: 72), and in some aspects at least one CDR that is distinct from the CDRs of the heavy chain sequence set forth in SEQ ID NO: 72.

In some embodiments, the VL region has an amino acid sequence comprising a light chain framework region (FR) 1 (FR-L1), an FR-L2, an FR-L3, and/or an FR-L4 of the light chain sequence set forth in SEQ ID NO: 9 (or an FR-L1, FR-L2, FR-L3, and/or FR-L4 that is at least at or about 75, 80, 85, 90, 91, 92, 93, 94, 95, 96, 97, 98, or 99% identical to the FR-L1, FR-L2, FR-L3, and/or FR-L4 of SEQ ID NO: 9), and in some aspects at least one CDR that is distinct from the CDRs of the light chain sequence set forth in SEQ ID NO: 9; and/or a VH region with an amino acid sequence having a heavy chain FR1 (FR-H1), an FR-H2, an FR-H3, and/or an FR-H4, of the heavy chain sequence set forth in SEQ ID NO: 6 (or an FR-H1, FR-H2, FR-H3, and/or FR-H4 that is at least at or about 75, 80, 85, 90, 91, 92, 93, 94, 95, 96, 97, 98, or 99% identical to the FR-H1, FR-H2, FR-H3, and/or FR-H4 of SEQ ID NO: 6), and in some aspects at least one CDR that is distinct from the CDRs of the heavy chain sequence set forth in SEQ ID NO: 6.

In some embodiments, the VL region has an amino acid sequence comprising a light chain framework region (FR) 1 (FR-L1), an FR-L2, an FR-L3, and/or an FR-L4 of the light chain sequence set forth in SEQ ID NO: 68 (or an FR-L1, FR-L2, FR-L3, and/or FR-L4 that is at least at or about 75, 80, 85, 90, 91, 92, 93, 94, 95, 96, 97, 98, or 99% identical to the FR-L1, FR-L2, FR-L3, and/or FR-L4 of SEQ ID NO: 68), and in some aspects at least one CDR distinct from CDRs of the light chain sequence set forth in SEQ ID NO: 68; and/or a VH region with an amino acid sequence having a heavy chain FR1 (FR-H1), an FR-H2, an FR-H3, and/or an FR-H4, of the heavy chain sequence set forth in SEQ ID NO: 70 (or an FR-H1, FR-H2, FR-H3, and/or FR-H4 that is at least at or about 75, 80, 85, 90, 91, 92, 93, 94, 95, 96, 97, 98, or 99% identical to the FR-H1, FR-H2, FR-H3, and/or FR-H4 of SEQ ID NO: 70), and in some aspects at least one CDR distinct from CDRs of the heavy chain sequence set forth in SEQ ID NO: 70.

In some embodiments, the VL region has an amino acid sequence comprising a light chain framework region (FR) 1 (FR-L1), an FR-L2, an FR-L3, and/or an FR-L4 of the light chain sequence set forth in SEQ ID NO: 61 (or an FR-L1, FR-L2, FR-L3, and/or FR-L4 that is at least at or about 75, 80, 85, 90, 91, 92, 93, 94, 95, 96, 97, 98, or 99% identical to the FR-L1, FR-L2, FR-L3, and/or FR-L4 of SEQ ID NO: 61), and in some aspects at least one CDR that is distinct from the CDRs of the light chain sequence set forth in SEQ ID NO: 61; and/or a VH region with an amino acid sequence having a heavy chain FR1 (FR-H1), an FR-H2, an FR-H3, and/or an FR-H4, of the heavy chain sequence set forth in SEQ ID NO: 63 (or an FR-H1, FR-H2, FR-H3, and/or FR-H4 that is at least at or about 75, 80, 85, 90, 91, 92, 93, 94, 95, 96, 97, 98, or 99% identical to the FR-H1, FR-H2, FR-H3, and/or FR-H4 of SEQ ID NO: 63), and in some aspects at least one CDR that is distinct from the CDRs of the heavy chain sequence set forth in SEQ ID NO: 63. In some embodiments, the meditope-enabled antibody has one or more CDRs distinct from the CDRs set forth in SEQ ID NO: 6, 7, 9, 10, 12, 14, 61, 63, 68, 69, 70, 71, and/or 72.

In some embodiments, the meditope is an antibody other than cetuximab, does not specifically bind to an EGFR, binds to an antigen other than EGFR, and/or does not specifically bind to the epitope on EGFR that is specifically bound by cetuximab.

In some examples, the meditope-enabled antibody is generated based on a template antibody that is selected from among abagovomab, abciximab, adalimumab, adecatumumab, alemtuzumab, altumomab, altumomab pentetate, anatumomab, anatumomab mafenatox, arcitumomab, atlizumab, basiliximab, bectumomab, ectumomab, belimumab, benralizumab, bevacizumab, brentuximab, canakinumab, capromab, capromab pendetide, catumaxomab, certolizumab, clivatuzumab tetraxetan, daclizumab, denosumab, eculizumab, edrecolomab, efalizumab, etaracizumab, ertumaxomab, fanolesomab, Fbta05, fontolizumab, gemtuzumab, lintuzumab, girentuximab, golimumab, ibritumomab, igovomab, infliximab, ipilimumab, labetuzumab, mepolizumab, muromonab, muromonab-CD3, natalizumab, necitumumab nimotuzumab, ofatumumab, omalizumab, oregovomab, palivizumab, panitumumab, ranibizumab, rituximab, satumomab, sulesomab, ibritumomab, ibritumomab tiuxetan, tocilizumab, tositumomab, trastuzumab, Trbs07, ustekinumab, visilizumab, votumumab, zalutumumab, brodalumab, anrukinzumab, bapineuzumab, dalotuzumab, demcizumab, ganitumab, inotuzumab, mavrilimumab, moxetumomab pasudotox, rilotumumab, sifalimumab, tanezumab, tralokinumab, tremelimumab, the antibody produced by the hybridoma 10B5, B6H12.2, and urelumab, fragments thereof, antibodies having the CDRs and/or antigen-binding regions thereof, and/or antibodies that compete for binding with such antibodies; and/or antibodies having a sequence set forth in any of SEQ ID NOs: 78-124, and/or 125-170, fragments thereof antibodies having the CDRs and/or antigen-binding regions thereof, and/or antibodies that compete for binding with such antibodies. Table 3 lists CAS® Registry Numbers for certain antibodies.

TABLE 3

| Antibody | CAS Registry number |
|---|---|
| abagovomab | 792921-10-9 |
| abciximab | 143653-53-6 |
| adalimumab | 331731-18-1 |
| adecatumumab | 503605-66-1 |
| alemtuzumab | 216503-57-0 |
| indium (111In) altumomab pentetate | 156586-92-4 |
| arcitumomab | 154361-48-5 |

TABLE 3-continued

| Antibody | CAS Registry number |
|---|---|
| arcitumomab | 154361-48-5 |
| atlizumab | 375823-41-9 |
| basiliximab | 152923-56-3 |
| bectumomab | 158318-63-9 |
| belimumab | 356547-88-1 |
| benralizumab | 1044511-01-4 |
| bevacizumab | 216974-75-3 |
| brentuximab | 914088-09-8 |
| canakinumab | 914613-48-2 |
| capromab pendetide | 145464-28-4 |
| capromab | 151763-64-3 |
| catumaxomab | 509077-98-9 |
| certolizumab | 428863-50-7 |
| certolizumab | 428863-50-7 |
| cetuximab | 205923-56-4 |
| clivatuzumab tetraxetan | 943976-23-6 |
| daclizumab | 152923-56-3 |
| denosumab | 615258-40-7 |
| eculizumab | 219685-50-4 |
| edrecolomab | 156586-89-9 |
| efalizumab | 214745-43-4 |
| etaracizumab | 892553-42-3 |
| etrumaxomab | 509077-99-0 |
| fanolesomab | 225239-31-6 |
| FBTA05 | Lymphomun/FBTA05 |
| fontolizumab | 326859-36-3 |
| gemtuzumab | 220578-59-6 |
| lintuzumab | 166089-32-3 |
| girentuximab | 916138-87-9 |
| golimumab | 476181-74-5 |
| ibritumomab | 174722-31-7 |
| igovomab | 171656-50-1 |
| Infliximab | 170277-31-3 |
| ipilimumab | 477202-00-9 |
| labetuzumab | 219649-07-7 |
| mepolizumab | 196078-29-2 |
| muromonab-CD3 | 140608-64-6 |
| natalizumab | 189261-10-7 |
| nimotuzumab | 828933-61-3 |
| ofatumumab | 679818-59-8 |
| omalizumab | 242138-07-4 |
| oregovomab | 213327-37-8 |
| palivizumab | 188039-54-5 |
| panitumumab | 339177-26-3 |
| ranibizumab | 347396-82-1 |
| rituximab | 174722-31-7 |
| satumomab | 138955-26-7 |
| sulesomab | 167747-19-5 |
| tiuxetan (ibritumomab) | 174722-31-7 |
| tocilizumab | 375823-41-9 |
| tositumomab | 192391-48-3 |
| trastuzumab | 180288-69-1 |
| ustekinumab | 815610-63-0 |
| votumumab | 148189-70-2 |
| zalutumumab | 667901-13-5 |
| brodalumab | 1174395-19-7 |
| anrukinzumab | 910649-32-0 |
| bapineuzumab | 648895-38-9 |
| dalotuzumab | 1005389-60-5 |
| demcizumab (OMP-21M18) | 1292853-12-3 |
| ganitumab | 905703-97-1 |
| inotuzumab | 635715-01-4 |
| mavrilimumab | 1085337-57-0 |
| moxetumomab | 1020748-57-5 |
| moxetumomab pasudotox | 1020748-57-5 |
| rilotumumab | 872514-65-3 |
| sifalimumab | 1143503-67-6 |
| tanezumab | 880266-57-9 |
| tralokinumab | 1044515-88-9 |
| tremelimumab | 745013-59-6 |
| urelumab | 934823-49-1 |
| necitumumab | 906805-06-9 |

In other examples, the template antibody is selected from among: abagovomab, abciximab, adalimumab, adecatumumab, alemtuzumab, altumomab, altumomab pentetate, anatumomab, anatumomab mafenatox, arcitumomab, atlizumab, basiliximab, bectumomab, ectumomab, belimumab, benralizumab, bevacizumab, brentuximab, canakinumab, capromab, capromab pendetide, catumaxomab, certolizumab, clivatuzumab tetraxetan, daclizumab, denosumab, eculizumab, edrecolomab, efalizumab, etaracizumab, ertumaxomab, fanolesomab, Fbta05, fontolizumab, gemtuzumab, lintuzumab, girentuximab, golimumab, ibritumomab, igovomab, infliximab, ipilimumab, labetuzumab, mepolizumab, muromonab, muromonab-CD3, natalizumab, necitumumab, nimotuzumab, ofatumumab, omalizumab, oregovomab, palivizumab, panitumumab, ranibizumab, rituximab, satumomab, sulesomab, ibritumomab, ibritumomab tiuxetan, tocilizumab, tositumomab, trastuzumab, Trbs07, ustekinumab, visilizumab, votumumab, zalutumumab, the antibody produced by the hybridoma 10B5, and brodalumab, or tiuzetan. In some such examples, the one or more CDRs are CDRs present in these template antibodies, and/or the antibodies specifically bind to the same antigen or epitope as such antibodies, and/or compete for binding with such antibodies to their antigens.

Thus, in some cases, the meditope-enabled antibodies (including fragments thereof) specifically binds to an antigen selected from the group consisting of: CA-125, glycoprotein (GP) IIb/IIIa receptor, TNF-alpha, CD52, TAG-72, Carcinoembryonic antigen (CEA), interleukin-6 receptor (IL-6R), IL-2, interleukin-2 receptor a-chain (CD25), CD22, CD23 (also known as CD23A, Fc epsilon MI, FcεRII, FCE2, CLEC4J, C-Type Lectin Domain Family 4 Member J, Immunoglobulin E-Binding Factor, Lymphocyte IgE Receptor, BLAST-2, or IGEBF), CD37 (also known as tetraspanin-26, TSPAN26, tspan-26, or GP52-40), Mucin-1, Prolactin Receptor (also known as PRL-R), SDC-1 (also known as CD138, Syndecan Proteoglycan 1, Syndecan 1, or Heparan Sulfate Proteoglycan Fibroblast Growth Factor Receptor), B-cell activating factor, interleukin-5 receptor (CD125), VEGF, VEGF-A, CD30, IL-1beta, prostate specific membrane antigen (PSMA), CD3, EpCAM, EGF receptor (EGFR), MUC1, human interleukin-2 receptor, Tac, RANK ligand, a complement protein, e.g., C5, EpCAM, CD11a, e.g., human CD11a, an integrin, e.g., alpha-v beta-3 integrin, vitronectin receptor alpha v beta 3 integrin, HER2, neu, CD3, CD15, CD20 (small and/or large loops), Interferon gamma, CD33, CA-IX, TNF alpha, CTLA-4, carcinoembryonic antigen, IL-5, CD3 epsilon, CAM, Alpha-4-integrin, IgE, e.g., IgE Fc region, an RSV antigen, e.g., fusion protein of respiratory syncytial virus (RSV), TAG-72, NCA-90 (granulocyte cell antigen), IL-6, GD2, GD3, IL-12, IL-23, IL-17, CTAA16.88, IL13, interleukin-1 beta, beta-amyloid, IGF-1 receptor (IGF-1R), delta-like ligand 4 (DLL4), alpha subunit of granulocyte macrophage colony stimulating factor receptor, hepatocyte growth factor, IFN-alpha, nerve growth factor, IL-13, PD-L1, CD326, CD47, and CD137. In some examples, the meditope-enabled antigen binds to another antigen identified as a target in a disease or condition of interest, such as cancer or other disease.

1. CD19

In one embodiment, the template antibody is an anti-CD19 antibody, for example, a human or humanized antibody or a mouse antibody for CD19, such as MOR208, or an antibody having a heavy chain, light chain, VH, or VL, of such an antibody, or a functional fragment thereof. In some embodiments, the meditope-enabled antibody specifically binds to CD19. CD19 (or cluster of differentiation-19) is, for example, identified by NCBI Accession No. NP_001171569 or UniProt Identifier P15391. In one aspect, CD19 is found on the surface of B cells from earliest recognizable B-lineage cells during development to B-cell blasts but is lost on maturation to plasma cells. In certain aspects, CD19 is a regulatory molecule that decreases the threshold for antigen receptor-dependent stimulation.

In some embodiments, the template antibody comprises the amino acid sequence of SEQ ID NO: 226 and/or of SEQ ID NO: 227 (with or without a leader sequence), which set forth light chain and heavy chain amino acid sequences, respectively, of MOR208 (XmAb®5574) (a monoclonal antibody that specifically binds to CD19, e.g., CD19 of immature, mature and malignant B cells), and/or comprises the amino acid sequence of SEQ ID NO: 245 and/or 246 (with or without a leader sequence), which set forth VL and VH amino acid sequences of MOR208, respectively.

In some aspects, the meditope-enabled antibody or fragment has a CDR (i.e., one or more CDR, e.g., CDR1, CDR2, and/or CDR3) of the light chain sequence set forth in SEQ ID NO: 226, or of the light chain or VL of MOR208, and/or a CDR (i.e., one or more CDR, e.g., CDR1, CDR2, and/or CDR3) of the heavy chain set forth in SEQ ID NO: 227, or of the heavy chain or VH of MOR208.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the amino acid sequence set forth as SEQ ID NO: 245, with or without the leader sequence, and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the amino acid sequence of the VH region of the amino acid sequence set forth as SEQ ID NO: 246, with or without the leader sequence.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of MOR208, or of SEQ ID NO: 226; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of MOR208, or SEQ ID NO: 227; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of MOR208 or SEQ ID NO: 246; and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of MOR208 or SEQ ID NO: 245. In some embodiments, the antibody contains all or at least 95, 96, 97, 98, or 99% identity within one or more, e.g., all, of the CDRs within the heavy and/or light chain, as compared to MOR208 (e.g., as compared to the CDR(s) of SEQ ID NO: 226 or 227).

In some aspects, the meditope-enabled antibody does not specifically bind to the epitope of a CD19 that is specifically bound by MOR208, but does specifically bind CD19, or does not contain the CDRs of MOR208, and/or does not compete for antigen binding with MOR208, but does specifically bind to CD19.

In some embodiments, the meditope-enabled antibody or fragment has a light chain comprising the amino acid sequence of SEQ ID NO: 305 and/or has a heavy chain comprising the amino acid sequence of SEQ ID NO: 306. In some embodiments, the meditope-enabled antibody or fragment comprises the cQFD meditope, the variant 3 linker, and/or is fused to the heavy chain of a meditope enabled anti-CD19 antibody (e.g., SEQ ID NO: 306).

2. CD22

In some embodiments, the template antibody is an anti-CD22 antibody, for example, a human or humanized antibody or a mouse antibody for CD22, such as epratuzumab, or moxetumomab, or an antibody having a heavy chain, light chain, $V_H$, or $V_L$, of such an antibody, or a functional fragment thereof. In some embodiments, the meditope-enabled antibody specifically binds to CD22. CD22 (or cluster of differentiation-22) is a molecule belonging to the SIGLEC family of lectins, for example, as identified by NCBI Accession No. NP_001762 or UniProt Identifier P20273. In one aspect, CD22 is found on the surface of mature B cells and to a lesser extent on some immature B cells. In certain aspects, CD22 is a regulatory molecule that prevents the over-activation of the immune system and the development of autoimmune diseases. In one embodiment, a template antibody for CD22 specifically binds to one or more epitopes on a polypeptide or protein having the amino acid sequence of SEQ ID NO: 175, or a polypeptide or protein having the amino acid sequence encoded by a polynucleotide comprising the nucleic acid sequence of SEQ ID NO: 176.

In some embodiments, the template antibody comprises the amino acid sequence of SEQ ID NO: 177 and/or of SEQ ID NO: 178 (with or without the leader sequence, which in each sequence is identified by amino acid positions within the sequence), which set forth light chain and heavy chain amino acid sequences, respectively, of epratuzumab (a humanized monoclonal antibody that specifically binds to CD22, e.g., CD22 of mature and malignant B cells), and/or comprises the amino acid sequence of SEQ ID NO: 179 and/or 183 (with or without the leader sequence, which in each sequence is identified by amino acid positions within the sequence), which set forth $V_L$ and $V_H$ amino acid sequences of epratuzumab, respectively.

The epratuzumab light chain sequence is set forth in SEQ ID NO: 177, which comprises the leader sequence set forth in amino acid positions 1-20 in SEQ ID NO: 177. The epratuzumab heavy chain sequence is set forth in SEQ ID NO: 178, which comprises the leader sequence set forth in amino acid positions 1-19 in SEQ ID NO: 178. The epratuzumab light chain variable (VL) region sequence is set forth in SEQ ID NO: 179, which comprises the leader sequence set forth in amino acid positions 1-20 in SEQ ID NO: 179. The epratuzumab heavy chain variable (VH) region sequence is set forth in SEQ ID NO: 183, which comprises the leader sequence set forth in amino acid positions 1-19 in SEQ ID NO: 183.

In some aspects, the meditope-enabled antibody or fragment has a CDR (i.e., one or more CDR, e.g., CDR1, CDR2, and/or CDR3) of the light chain or VL sequence set forth in SEQ ID NO: 177 or SEQ ID NO: 179, or of the light chain or VL of epratuzumab, and/or a CDR (i.e., one or more CDR, e.g., CDR1, CDR2, and/or CDR3) of the heavy chain or VH sequence set forth in SEQ ID NO: 178 or 183, or of the heavy chain or VH of epratuzumab.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the amino acid sequence set forth as SEQ ID NO: 179, with or without the leader sequence, and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the amino acid sequence of SEQ ID NO: 183, with or without the leader sequence.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of epratuzumab, or of SEQ ID NO: 177 or of 179; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of epratuzumab, of SEQ ID NO: 178 or of 183; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of epratuzumab (e.g., to the amino acid sequence of SEQ ID NO: 183); and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of epratuzumab (e.g., to the amino acid sequence of SEQ ID NO: 179). In some embodiments, the antibody contains all or at least 95, 96, 97, 98, or 99% identity within one or more, e.g., all, of the CDRs within the heavy and/or light chain, as compared to epratuzumab (e.g., as compared to the CDR(s) of SEQ ID NO: 177 or 179 or SEQ ID NO: 178 or 183).

In some aspects, the meditope-enabled antibody does not specifically bind to the epitope of a CD22 that is specifically bound by epratuzumab, but does specifically bind CD22, or does not contain the CDRs of epratuzumab, and/or does not compete for antigen binding with epratuzumab, but does specifically bind to CD22.

In some embodiments, the template antibody comprises the amino acid sequence of SEQ ID NO: 65 and/or of SEQ ID NO: 67 (with or without the leader sequence/residue, which is the N-terminal methionine of SEQ ID NO: 67), which set forth $V_L$ and $V_H$ amino acid sequences, respectively, of moxetumomab (an anti-CD22 mouse monoclonal antibody), and/or comprises the amino acid sequence of SEQ ID NO: 66 (with or without the leader sequence, which is the N-terminal methionine of SEQ ID NO: 66), which sets forth a heavy chain amino acid sequence of moxetumomab.

In some aspects, the meditope-enabled antibody or fragment has a CDR (i.e., one or more CDR, e.g., CDR1, CDR2, and/or CDR3) of the VL sequence set forth in SEQ ID NO: 65, or of the light chain or VL of moxetumomab, and/or a CDR (i.e., one or more CDR, e.g., CDR1, CDR2, and/or CDR3) of the heavy chain or VH sequence set forth in SEQ ID NO: 66 or 67, or of the heavy chain or VH of moxetumomab.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the amino acid sequence set forth as SEQ ID NO: 65 with or without the leader sequence, or VL of moxetumomab and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the amino acid sequence of SEQ ID NO: 67, with or without the leader sequence, or VH of moxetumomab.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of moxetumomab, or of SEQ ID NO: 65; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of moxetumomab, of SEQ ID NO: 66 or 67; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of moxetumomab (e.g., to the amino acid sequence of SEQ ID NO: 67); and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of moxetumomab (e.g., to the amino acid sequence of SEQ ID NO: 65). In some embodiments, the antibody contains all or at least 95, 96, 97, 98, or 99% identity within one or more, e.g., all, of the CDRs within the heavy and/or light chain, as compared to moxetumomab (e.g., as compared to the CDR(s) of SEQ ID NO: 65 or 66 or 67).

In some aspects, the meditope-enabled antibody does not specifically bind to the epitope of a CD22 that is specifically bound by moxetumomab, but does specifically bind CD22, or does not contain the CDRs of moxetumomab, and/or does not compete for antigen binding with moxetumomab, but does specifically bind to CD22.

3. CD23

In one embodiment, the template antibody is an anti-CD23 antibody, for example, a human or humanized antibody or a mouse antibody for CD23, such as lumiliximab, or an antibody having a heavy chain, light chain, VH, or VL, of such an antibody, or a functional fragment thereof.

In some embodiments, the meditope-enabled antibody specifically binds to CD23. CD23 is also known as Fc epsilon RII, or FcεRII, is the "low-affinity" receptor for IgE, an antibody isotype involved in allergy and resistance to parasites, and is important in regulation of IgE levels. CD23 is a C-type lectin, for example, as identified by NCBI Accession No. NP_001193948.2 or UniProt Identifier P06734. CD23 antigen is a 45-kDa type II transmembrane glycoprotein that is expressed on several hematopoietic cell types. In some aspects, CD23 is expressed on mature B cells, activated macrophages, eosinophils, follicular dendritic cells, and platelets. CD23 is the only FcR that does not belong to the immunoglobulin gene superfamily. The functions of CD23 include modulation of IgE production by B cells and promoting the survival of germinal center-derived B cells. The expression of CD23 is highly upregulated in normally activated follicular B cells and in CLL cells.

In one embodiment, a template antibody for CD23 specifically binds to one or more epitopes on a polypeptide or protein having the amino acid sequence of SEQ ID NO: 172, or a polypeptide or protein having the amino acid sequence encoded by a polynucleotide comprising the nucleic acid sequence of SEQ ID NO: 184.

In some embodiments, the template antibody comprises the amino acid sequence of SEQ ID NO: 185 and/or of SEQ ID NO: 190 (with or without the leader sequence/residue, which where applicable corresponds to amino acids 1-22 of SEQ ID NO: 185 and amino acids 1-19 of SEQ ID NO: 190), which set forth VL and VH amino acid sequences, respectively, of lumiliximab.

Lumiliximab (also known as IDEC-152, P5E8, gomiliximab; Biogen Idec) is a primatized anti-CD23 mAb that contains cynomolgus macaque variable regions and human constant regions (IgG1-κ). It was originally developed to inhibit the production of IgE by activated human peripheral blood B cells; however, later on it gained an appreciation as a potent anti-CD23 mAb. Preclinical data suggest that lumiliximab mediates its antitumor effect on CLL cells and CD23-expressing B cells predominantly by the intrinsic pathway of apoptosis (i.e., inducing downregulation of anti-apoptotic proteins Bcl-2, Bcl-XL and XIAP, activation of Bax and release of mitochondrial cytochrome c). Synergistic cytotoxicity has also been demonstrated on CD23-expressing B-cell lines and primary CLL cells when lumiliximab was combined with rituximab or fludarabine in xenograft models. In a Phase I clinical trial of 46 heavily pretreated CLL patients, lumiliximab showed modest clinical activity as a single agent. Although no objective Complete Responses (CRs) or Partial Responses (PRs) were observed, lumiliximab did reduce enlarged lymph node size in 52% of patients and decreased peripheral blood lymphocyte counts in 91% of patients. The safety profile of lumiliximab demonstrated that the majority of adverse events (AEs) are limited to grade 1/2. Lumiliximab was not immunosuppressive and the MTD (maximum tolerated dose) was not reached.

In some aspects, the meditope-enabled antibody or fragment has a CDR (i.e., one or more CDR, e.g., CDR1, CDR2, and/or CDR3) of the VL sequence set forth in SEQ ID NO: 185, or of the light chain or VL of lumiliximab, and/or a CDR (i.e., one or more CDR, e.g., CDR1, CDR2, and/or CDR3) of the VH sequence set forth in SEQ ID NO: 190, or of the heavy chain or VH of lumiliximab.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the amino acid sequence set forth as SEQ ID NO: 185 with or without the leader sequence, or VL of lumiliximab and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the amino acid sequence of SEQ ID NO: 190, with or without the leader sequence, or VH of lumiliximab.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of lumiliximab, or of SEQ ID NO: 185; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of lumiliximab, of SEQ ID NO: 190; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of lumiliximab (e.g., to the amino acid sequence of SEQ ID NO: 190); and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of lumiliximab (e.g., to the amino acid sequence of SEQ ID NO: 185). In some embodiments, the antibody contains all or at least 95, 96, 97, 98, or 99% identity within one or more, e.g., all, of the CDRs within the heavy and/or light chain, as compared to lumiliximab (e.g., as compared to the CDR(s) of SEQ ID NO: 185 or 190).

In some aspects, the meditope-enabled antibody does not specifically bind to the epitope of a CD23 that is specifically bound by lumiliximab, but does specifically bind CD23, or does not contain the CDRs of lumiliximab, and/or does not compete for antigen binding with lumiliximab, but does specifically bind to CD23.

4. CD33

In one embodiment, the template antibody is an anti-CD33 antibody, for example, a human or humanized antibody or a mouse antibody for CD33, such as gemtuzumab, or an antibody having a heavy chain, light chain, VH, or VL, of such an antibody, or a functional fragment thereof. In some embodiments, the meditope-enabled antibody specifically binds to CD33. CD33 (or cluster of differentiation-33) is, for example, identified by UniProt Identifier P20138. In one aspect, CD33 is found on the surface of myeloid cells.

In some embodiments, the template antibody comprises the amino acid sequence of SEQ ID NO: 224 and/or of SEQ ID NO: 225 (with or without a leader sequence), which set forth light chain and heavy chain amino acid sequences, respectively, of gemtuzumab (Mylotarg) (a monoclonal antibody that specifically binds to CD33, e.g., CD33 of immature, mature and malignant B cells), and/or comprises the amino acid sequence of SEQ ID NO: 243 and/or 245 (with or without a leader sequence), which set forth VL and VH amino acid sequences of gemtuzumab, respectively.

In some embodiments, the meditope-enabled antibody or fragment has a light chain comprising the amino acid sequence of SEQ ID NO: 293 and/or has a heavy chain comprising the amino acid sequence of SEQ ID NO: 294. In some embodiments, the meditope-enabled antibody or fragment comprises the cQFD meditope, the variant 1 linker, and/or is fused to the heavy chain of a meditope enabled gemtuzumab (e.g., SEQ ID NO: 294).

In some embodiments, the meditope-enabled antibody or fragment has a light chain comprising the amino acid sequence of SEQ ID NO: 295 and/or has a heavy chain comprising the amino acid sequence of SEQ ID NO: 296. In some embodiments, the meditope-enabled antibody or fragment comprises the cQFD meditope, the variant 2 linker, and/or is fused to the heavy chain of a meditope enabled gemtuzumab (e.g., SEQ ID NO: 296).

In some embodiments, the meditope-enabled antibody or fragment has a light chain comprising the amino acid sequence of SEQ ID NO: 297 and/or has a heavy chain comprising the amino acid sequence of SEQ ID NO: 298. In some embodiments, the meditope-enabled antibody or fragment comprises the cQFD meditope, the variant 3 linker, and/or is fused to the heavy chain of a meditope enabled gemtuzumab (e.g., SEQ ID NO: 298).

In some aspects, the meditope-enabled antibody or fragment has a CDR (i.e., one or more CDR, e.g., CDR1, CDR2, and/or CDR3) of the light chain sequence set forth in SEQ ID NO: 224, or of the light chain or VL of gemtuzumab, and/or a CDR (i.e., one or more CDR, e.g., CDR1, CDR2, and/or CDR3) of the heavy chain set forth in SEQ ID NO: 225, or of the heavy chain or VH of gemtuzumab.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the amino acid sequence set forth as SEQ ID NO: 243, with or without the leader sequence, and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the amino acid sequence of the VH region of the amino acid sequence set forth as SEQ ID NO: 244, with or without the leader sequence.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of gemtuzumab, or of SEQ ID NO: 224; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of gemtuzumab, or SEQ ID NO: 225; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of gemtuzumab or SEQ ID NO: 244; and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of gemtuzumab or SEQ ID NO: 243. In some embodiments, the antibody contains all or at least 95, 96, 97, 98, or 99% identity within one or more, e.g., all, of the CDRs within the heavy and/or light chain, as compared to gemtuzumab (e.g., as compared to the CDR(s) of SEQ ID NO: 224 or 225).

In some aspects, the meditope-enabled antibody does not specifically bind to the epitope of a CD33 that is specifically bound by gemtuzumab, but does specifically bind CD33, or does not contain the CDRs of gemtuzumab, and/or does not compete for antigen binding with gemtuzumab, but does specifically bind to CD33.

In one embodiment, the present disclosure provides a meditope-enabled lintuzumab. In one embodiment, the meditope-enabled lintuzumab comprises a heavy chain of SEQ ID NO: 289, 290, 291 or 292. In one embodiment, the meditope-enabled lintuzumab comprises a light chain of SEQ ID NO: 285, 286, 287 or 288. The original amino acid sequences of lintuzumab are provided in SEQ ID NO: 284 (heavy chain) and 283 (light chain) as references.

In one embodiment, the template antibody is an anti-CD33 antibody, for example, a human or humanized antibody or a mouse antibody for CD33, such as lintuzumab, or an antibody having a heavy chain, light chain, VH, or VL, of such an antibody, or a functional fragment thereof. In some embodiments, the meditope-enabled antibody specifically binds to CD33. CD33 (or cluster of differentiation-33) is, for example, identified by UniProt Identifier P20138. In one aspect, CD33 is found on the surface of myeloid cells.

In some embodiments, the template antibody comprises the amino acid sequence of SEQ ID NO: 285-288 and/or of SEQ ID NO: 289-292 (with or without a leader sequence shown as underlined residues), which set forth light chain and heavy chain amino acid sequences, respectively, of lintuzumab (a monoclonal antibody that specifically binds to CD33, e.g., CD33 of immature, mature and malignant B cells).

In some aspects, the meditope-enabled antibody or fragment has a CDR (i.e., one or more CDR, e.g., CDR1, CDR2, and/or CDR3) of the light chain sequence set forth in SEQ ID NO: 284, or of the light chain or VL of lintuzumab, and/or a CDR (i.e., one or more CDR, e.g., CDR1, CDR2, and/or CDR3) of the heavy chain set forth in SEQ ID NO: 283, or of the heavy chain or VH of lintuzumab.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications).

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of lintuzumab, or of SEQ ID NO: 285-288; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of lintuzumab, or SEQ ID NO: 289-292; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of lintuzumab or SEQ ID NO: 289-292; and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of lintuzumab or SEQ ID NO: 285-288. In some embodiments, the antibody contains all or at least 95, 96, 97, 98, or 99% identity within one or more, e.g., all, of the CDRs within the heavy and/or light chain, as compared to lintuzumab (e.g., as compared to the CDR(s) of SEQ ID NO: 285-288 or 289-292).

In some aspects, the meditope-enabled antibody does not specifically bind to the epitope of a CD33 that is specifically bound by lintuzumab, but does specifically bind CD33, or does not contain the CDRs of lintuzumab, and/or does not compete for antigen binding with lintuzumab, but does specifically bind to CD33.

5. CD37

In one embodiment, the template antibody is an anti-CD37 antibody, for example, a human or humanized antibody or a mouse antibody for CD37, such as otlertuzumab, or an antibody having a heavy chain, light chain, VH, or VL, of such an antibody, or a functional fragment thereof.

In some embodiments, the meditope-enabled antibody specifically binds to CD37. CD37, also known as GP52-40 or TSPAN26, is a member of the transmembrane 4 superfamily, also known as the tetraspanin family. WO 2011112978 discloses CD37-binding molecules and immunoconjugates thereof, the disclosure of which is incorporated herein by reference in its entirety for all purposes.

In one embodiment, a template antibody for CD37 specifically binds to one or more epitopes on a polypeptide or protein having the amino acid sequence of SEQ ID NO: 191, or a polypeptide or protein having the amino acid sequence encoded by a polynucleotide comprising the nucleic acid sequence of SEQ ID NO: 192.

In some embodiments, the template antibody comprises the amino acid sequence of SEQ ID NO: 193 and/or of SEQ ID NO: 194, which set forth VL and VH amino acid sequences, respectively, of otlertuzumab. Otlertuzumab (also known as Betalutin or IMGN529) targets CD37, which has an expression profile similar to that of CD20 on NHL subtypes.

In some aspects, the meditope-enabled antibody or fragment has a CDR (i.e., one or more CDR, e.g., CDR1, CDR2, and/or CDR3) of the VL sequence set forth in SEQ ID NO: 193, or of the light chain or VL of otlertuzumab, and/or a CDR (i.e., one or more CDR, e.g., CDR1, CDR2, and/or CDR3) of the VH sequence set forth in SEQ ID NO: 194, or of the heavy chain or VH of otlertuzumab.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the amino acid sequence set forth as SEQ ID NO: 193, or VL of otlertuzumab and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the amino acid sequence of SEQ ID NO: 194, or VH of otlertuzumab.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of otlertuzumab, or of SEQ ID NO: 193; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of otlertuzumab, of SEQ ID NO: 194; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of otlertuzumab (e.g., to the amino acid sequence of SEQ ID NO: 194); and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of otlertuzumab (e.g., to the amino acid sequence of SEQ ID NO: 193). In some embodiments, the antibody contains all or at least 95, 96, 97, 98, or 99% identity within one or more, e.g., all, of the CDRs within the heavy and/or light chain, as compared to otlertuzumab (e.g., as compared to the CDR(s) of SEQ ID NO: 193 or 194).

In some aspects, the meditope-enabled antibody does not specifically bind to the epitope of a CD37 that is specifically bound by otlertuzumab, but does specifically bind CD37, or does not contain the CDRs of otlertuzumab, and/or does not compete for antigen binding with otlertuzumab, but does specifically bind to CD37.

6. Mucin-1

In one embodiment, the template antibody is an anti-Mucin-1 antibody, for example, a human or humanized antibody or a mouse antibody for Mucin-1, such as hPAM4-Cide (also known as clivatuzumab tetraxetan), or an antibody having a heavy chain, light chain, VH, or VL, of such an antibody, or a functional fragment thereof.

In some embodiments, the meditope-enabled antibody specifically binds to Mucin 1. Mucin-1 is also known as Mucin 1, cell surface associated (MUC1), or polymorphic epithelial mucin (PEM)) and is a mucin encoded by the MUC1 gene in humans, of example, as identified by NCBI Accession No. NP_001018021 or UniProt Identifier P15941. In one embodiment, a template antibody for Mucin-1 specifically binds to one or more epitopes on a polypeptide or protein having the amino acid sequence of SEQ ID NO: 195, or a polypeptide or protein having the amino acid sequence encoded by a polynucleotide comprising the nucleic acid sequence of SEQ ID NO: 196.

In some embodiments, the template antibody comprises the amino acid sequence of SEQ ID NO: 197 and/or of SEQ ID NO: 198, which set forth VL and VH amino acid sequences, respectively, of hPAM4-Cide (also known as clivatuzumab tetraxetan), respectively. WO 2010042562 discloses additional Mucin-1 antibodies, the disclosure of which is incorporated herein by reference for all purposes.

In some aspects, the meditope-enabled antibody or fragment has a CDR (i.e., one or more CDR, e.g., CDR1, CDR2, and/or CDR3) of the VL sequence set forth in SEQ ID NO: 197, or of the light chain or VL of hPAM4-Cide, and/or a CDR (i.e., one or more CDR, e.g., CDR1, CDR2, and/or CDR3) of the VH sequence set forth in SEQ ID NO: 198, or of the heavy chain or VH of hPAM4-Cide.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the amino acid sequence set forth as SEQ ID NO: 197 with or without the leader sequence, or VL of hPAM4-Cide and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the amino acid sequence of SEQ ID NO: 198, with or without the leader sequence, or VH of hPAM4-Cide.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of hPAM4-Cide, or of SEQ ID NO: 197; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of hPAM4-Cide, of SEQ ID NO: 198; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of hPAM4-Cide (e.g., to the amino acid sequence of SEQ ID NO: 198); and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of hPAM4-Cide (e.g., to the amino acid sequence of SEQ ID NO: 197). In some embodiments, the antibody contains all or at least 95, 96, 97, 98, or 99% identity within one or more, e.g., all, of the CDRs within the heavy and/or light chain, as compared to hPAM4-Cide (e.g., as compared to the CDR(s) of SEQ ID NO: 197 or 198). SEQ ID NO:197 shows an hPAM4-Cide light chain variable (VL) region sequence and SEQ ID NO:198 shows an hPAM4-Cide heavy chain variable (HL) region sequence.

In some aspects, the meditope-enabled antibody does not specifically bind to the epitope of a Mucin1 that is specifically bound by hPAM4-Cide, but does specifically bind Mucin1, or does not contain the CDRs of hPAM4-Cide, and/or does not compete for antigen binding with hPAM4-Cide, but does specifically bind to Mucin1.

7. Prolactin Receptor

In one embodiment, the template antibody is an anti-prolactin receptor (PRLR) antibody, for example, a human or humanized antibody or a mouse antibody for prolactin receptor, such as LFA-102 or 002-H08, or an antibody having a heavy chain, light chain, VH, or VL, of such an antibody, or a functional fragment thereof.

In some embodiments, the meditope-enabled antibody specifically binds to prolactin receptor. In one aspect, the prolactin receptor is encoded by a gene on Chromosome 5p13-14, and interacts with the prolactin molecule as a transmembrane receptor. The prolactin receptor contains an extracellular region that binds prolactin, a transmembrane region, and a cytoplasmic region.

In some embodiments, the template antibody comprises the amino acid sequence of a VL and/or VH amino acid sequence of LFA-102, which is a humanized monoclonal antibody of the IgG1 kappa subtype, and binds to the putative dimerization region of PRLR in a non-ligand competitive manner and inhibits PRL-induced signaling.

In some aspects, the meditope-enabled antibody or fragment has a CDR (i.e., one or more CDR, e.g., CDR1, CDR2, and/or CDR3) of the VL of LFA-102, and/or a CDR (i.e., one or more CDR, e.g., CDR1, CDR2, and/or CDR3) of the VH of LFA-102.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the VL of LFA-102 and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the VH of LFA-102.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of LFA-102; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of LFA-102; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of LFA-102; and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of LFA-102. In some embodiments, the antibody contains all or at least 95, 96, 97, 98, or 99% identity within one or more, e.g., all, of the CDRs within the heavy and/or light chain, as compared to LFA-102.

In some aspects, the meditope-enabled antibody does not specifically bind to the epitope of a prolactin receptor that is specifically bound by LFA-102, but does specifically bind prolactin receptor, or does not contain the CDRs of LFA-102, and/or does not compete for antigen binding with LFA-102, but does specifically bind to prolactin receptor.

In some embodiments, the template antibody comprises the amino acid sequence of SEQ ID NO: 208 and/or of SEQ ID NO: 209, which set forth VL and VH amino acid sequences, respectively, of 002-H08. Application Publication No. US 20120315276 discloses prolactin receptor antibodies including 002-H08, the disclosure of which is incorporated herein by reference for all purposes.

In some aspects, the meditope-enabled antibody or fragment has a CDR (i.e., one or more CDR, e.g., CDR1, CDR2, and/or CDR3) of the VL sequence set forth in SEQ ID NO: 208, or of the light chain or VL of 002-H08, and/or a CDR (i.e., one or more CDR, e.g., CDR1, CDR2, and/or CDR3) of the VH sequence set forth in SEQ ID NO: 209, or of the heavy chain or VH of 002-H08.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the amino acid sequence set forth as SEQ ID NO: 208, or VL of 002-H08 and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the amino acid sequence of SEQ ID NO: 209, or VH of 002-H08.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of 002-H08, or of SEQ ID NO: 208; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of 002-H08, of SEQ ID NO: 209; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of 002-H08 (e.g., to the amino acid sequence of SEQ ID NO: 209); and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of 002-H08 (e.g., to the amino acid sequence of SEQ ID NO: 208). In some embodiments, the antibody contains all or at least 95, 96, 97, 98, or 99% identity within one or more, e.g., all, of the CDRs within the heavy and/or light chain, as compared to 002-H08 (e.g., as compared to the CDR(s) of SEQ ID NO: 208 or 209).

In some aspects, the meditope-enabled antibody does not specifically bind to the epitope of a prolactin receptor that is specifically bound by 002-H08, but does specifically bind prolactin receptor, or does not contain the CDRs of 002-H08, and/or does not compete for antigen binding with 002-H08, but does specifically bind to prolactin receptor.

8. SDC-1

In one embodiment, the template antibody is an anti-SDC-1 antibody, for example, a human or humanized antibody or a mouse antibody for SDC-1 (also known as Syndecan 1, or CD138), such as indatuximab ravtansine, or an antibody having a heavy chain, light chain, VH, or VL, of such an antibody, or a functional fragment thereof.

In some embodiments, the meditope-enabled antibody specifically binds to SDC-1. In one aspect, SDC-1 is a transmembrane (type I) heparan sulfate proteoglycan and is a member of the syndecan proteoglycan family. The syndecans mediate cell binding, cell signaling, and cytoskeletal organization and syndecan receptors are required for internalization of the HIV-1 tat protein. The syndecan-1 protein functions as an integral membrane protein and participates in cell proliferation, cell migration and cell-matrix interactions via its receptor for extracellular matrix proteins. Altered syndecan-1 expression has been detected in several different tumor types. While several transcript variants may exist for this gene, the full-length natures of only two have been described to date. These two represent the major variants of this gene and encode the same protein. In one embodiment, a template antibody for SDC-1 specifically binds to one or more epitopes on a polypeptide or protein having the amino acid sequence of SEQ ID NO: 210.

In some embodiments, the template antibody comprises the amino acid sequence of SEQ ID NO: 211 and/or of SEQ ID NO: 212, which set forth VL and VH amino acid sequences, respectively, of indatuximab ravtansine. Indatuximab ravtansine (also known as BT-062, BT062, or B-B4) is a SDC-1 antibody.

In some aspects, the meditope-enabled antibody or fragment has a CDR (i.e., one or more CDR, e.g., CDR1, CDR2, and/or CDR3) of the VL sequence set forth in SEQ ID NO: 211, or of the light chain or VL of indatuximab ravtansine, and/or a CDR (i.e., one or more CDR, e.g., CDR1, CDR2, and/or CDR3) of the VH sequence set forth in SEQ ID NO: 212, or of the heavy chain or VH of indatuximab ravtansine.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the amino acid sequence set forth as SEQ ID NO: 211, or VL of indatuximab ravtansine and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the amino acid sequence of SEQ ID NO: 212, with or without the leader sequence, or VH of indatuximab ravtansine.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of indatuximab ravtansine, or of SEQ ID NO: 211; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of indatuximab ravtansine, of SEQ ID NO: 212; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of indatuximab ravtansine (e.g., to the amino acid sequence of SEQ ID NO: 212); and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of indatuximab ravtansine (e.g., to the amino acid sequence of SEQ ID NO: 211). In some embodiments, the antibody contains all or at least 95, 96, 97, 98, or 99% identity within one or more, e.g., all, of the CDRs within the heavy and/or light chain, as compared to indatuximab ravtansine (e.g., as compared to the CDR(s) of SEQ ID NO: 211 or 212).

In some aspects, the meditope-enabled antibody does not specifically bind to the epitope of a SDC-1 that is specifically bound by indatuximab ravtansine, but does specifically bind SDC-1, or does not contain the CDRs of indatuximab ravtansine, and/or does not compete for antigen binding with indatuximab ravtansine, but does specifically bind to SDC-1.

9. HER-2

In one embodiment, the template antibody is an anti-HER-2 antibody, for example, a human or humanized antibody or a mouse antibody for HER-2 (also known as ERBB2), such as trastuzumab (Herceptin®), or an antibody having a heavy chain, light chain, VH, or VL, of such an antibody, or a functional fragment thereof.

In some embodiments, the meditope-enabled antibody specifically binds to HER-2. In some aspects, the meditope-enabled antibody or fragment has a CDR (i.e., one or more CDR, e.g., CDR1, CDR2, and/or CDR3) of the VL sequence set forth in SEQ ID NO: 303, or of the light chain or VL of trastuzumab, and/or a CDR (i.e., one or more CDR, e.g., CDR1, CDR2, and/or CDR3) of the VH sequence set forth in SEQ ID NO: 304, or of the heavy chain or VH of trastuzumab.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the amino acid sequence of trastuzumab and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the amino acid sequence of trastuzumab.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of trastuzumab; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of trastuzumab; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of trastuzumab; and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of trastuzumab. In some embodiments, the antibody contains all or at least 95, 96, 97, 98, or 99% identity within one or more, e.g., all, of the CDRs within the heavy and/or light chain, as compared to trastuzumab.

In some aspects, the meditope-enabled antibody does not specifically bind to the epitope of a HER-2 that is specifically bound by trastuzumab, but does specifically bind HER-2, or does not contain the CDRs of trastuzumab, and/or does not compete for antigen binding with trastuzumab, but does specifically bind to HER-2.

In some embodiments, the meditope-enabled antibody or fragment has a light chain comprising the amino acid sequence of SEQ ID NO: 303 and/or has a heavy chain comprising the amino acid sequence of SEQ ID NO: 304. In some embodiments, the meditope-enabled antibody or fragment comprises the cQFD meditope, the variant 3 linker, and/or is fused to the heavy chain of a meditope enabled trastuzumab (e.g., SEQ ID NO: 304).

10. EGFR

In one embodiment, the template antibody is an anti-EGFR antibody, for example, a human or humanized antibody or a mouse antibody for EGFR, such as ABT-806, zatuximab, or an antibody having a heavy chain, light chain, VH, or VL, of such an antibody, or a functional fragment thereof. In some aspects, the anti-EGFR template antibody is not cetuximab, does not contain all or some CDRs of cetuximab, and/or does not compete for binding with cetuximab.

In one embodiment, a template antibody for EGFR specifically binds to one or more epitopes on a polypeptide or protein having the amino acid sequence of SEQ ID NO: 213, or a polypeptide or protein having the amino acid sequence encoded by a polynucleotide comprising the nucleic acid sequence of SEQ ID NO: 214.

In some embodiments, the template antibody comprises the amino acid sequence of SEQ ID NO: 215 and/or of SEQ ID NO: 216, which set forth VL and VH amino acid sequences, respectively, of ABT-806 (also known as mAb806/414), which is an EGFR antibody, and/or comprises the amino acid sequence of SEQ ID NO: 217 and SEQ ID NO: 218 which set forth light chain and heavy chain sequences of ABT-806, respectively.

In some aspects, the meditope-enabled antibody or fragment has a CDR (i.e., one or more CDR, e.g., CDR1, CDR2, and/or CDR3) of the VL sequence set forth in SEQ ID NO: 215, or of the light chain or VL of ABT-806, and/or a CDR (i.e., one or more CDR, e.g., CDR1, CDR2, and/or CDR3) of the VH sequence set forth in SEQ ID NO: 216, or of the heavy chain or VH of ABT-806.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the amino acid sequence set forth as SEQ ID NO: 215, or VL of ABT-806 and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the amino acid sequence of SEQ ID NO: 216, or VH of ABT-806.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of ABT-806, or of SEQ ID NO: 215; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of ABT-806, of SEQ ID NO: 216; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of ABT-806 (e.g., to the amino acid sequence of SEQ ID NO: 216); and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of ABT-806 (e.g., to the amino acid sequence of SEQ ID NO: 215). In some embodiments, the antibody contains all or at least 95, 96, 97, 98, or 99% identity within one or more, e.g., all, of the CDRs within the heavy and/or light chain, as compared to ABT-806 (e.g., as compared to the CDR(s) of SEQ ID NO: 215 or 216).

In some aspects, the meditope-enabled antibody does not specifically bind to the epitope of a EGFR that is specifically bound by ABT-806, but does specifically bind EGFR, or does not contain the CDRs of ABT-806, and/or does not compete for antigen binding with ABT-806, but does specifically bind to EGFR.

In some embodiments, the template antibody comprises the amino acid sequence of SEQ ID NO: 219 and/or of SEQ ID NO: 220, which set forth VL and VH amino acid sequences, respectively, of zatuximab, and/or comprises the amino acid sequence of SEQ ID NO: 221 and/or 222, which set forth light and heavy chain sequences of zatuximab, an EGFR antibody.

In some aspects, the meditope-enabled antibody or fragment has a CDR (i.e., one or more CDR, e.g., CDR1, CDR2, and/or CDR3) of the VL sequence set forth in SEQ ID NO: 219, or of the light chain or VL of zatuximab, and/or a CDR (i.e., one or more CDR, e.g., CDR1, CDR2, and/or CDR3) of the VH sequence set forth in SEQ ID NO: 220, or of the heavy chain or VH of zatuximab.

In some aspects, the VL region of the meditope-enabled antibody contains one or more, generally a plurality of modifications (which generally are in the framework regions), such as 1, 2, 3, 4, 5, 6, 7, 8, 9, 10, 11, 12, 13, 14, 15, 16, 17, 18, 19, or 20 modifications, compared to the amino acid sequence set forth as SEQ ID NO: 219, or VL of zatuximab and/or the VH region of the meditope-enabled antibody contains one or more, e.g., a plurality of modifications (which generally are in the framework regions), such as 1, 2, 3, 4, 5, 6, 7, 8, 9, 10, 11, 12, 13, 14, 15, 16, 17, 18, 19, or 20 modifications) compared to the amino acid sequence of SEQ ID NO: 220, or VH of zatuximab.

In some embodiments, the meditope-enabled antibody contains, within its light chain framework regions (or within one or more such regions, e.g., within FR-L1, FR-L2, FR-L3, and/or FR-L4), at least at or about 75, 76, 77, 78, 79, 80, 81, 82, 83, 84, 85, 86, 87, 88, 89, 90, 91, 92, 93, 94, 95, 96, 97, 98, or 99% identity to the light chain framework regions (or respective one or more FR-L(s)) of zatuximab, or of SEQ ID NO: 219; and/or contains, within its heavy chain framework regions (or within one or more such regions, e.g., within FR-H1, FR-H2, FR-H3, and/or FR-H4), at least at or about 75, 76, 77, 78, 79, 80, 81, 82, 83, 84, 85, 86, 87, 88, 89, 90, 91, 92, 93, 94, 95, 96, 97, 98, or 99% identity to the heavy chain framework regions (or respective one or more FR-H) of zatuximab, of SEQ ID NO: 220; and/or contains, within its VH region, at least at or about 75, 76, 77, 78, 79, 80, 81, 82, 83, 84, 85, 86, 87, 88, 89, 90, 91, 92, 93, 94, 95, 96, 97, 98, or 99% identity to the VH region of zatuximab (e.g., to the amino acid sequence of SEQ ID NO: 220); and/or contains, within its VL region, at least at or about 75, 76, 77, 78, 79, 80, 81, 82, 83, 84, 85, 86, 87, 88, 89, 90, 91, 92, 93, 94, 95, 96, 97, 98, or 99% identity to the VL region of zatuximab (e.g., to the amino acid sequence of SEQ ID NO: 220). In some embodiments, the antibody contains all or at least 95, 96, 97, 98, or 99% identity within one or more, e.g., all, of the CDRs within the heavy and/or light chain, as compared to zatuximab (e.g., as compared to the CDR(s) of SEQ ID NO: 219 or 220).

In some aspects, the meditope-enabled antibody does not specifically bind to the epitope of a EGFR that is specifically bound by zatuximab, but does specifically bind EGFR, or does not contain the CDRs of zatuximab, and/or does not compete for antigen binding with zatuximab, but does specifically bind to EGFR.

In some embodiments, the meditope-enabled antibody or fragment has a light chain comprising the amino acid sequence of SEQ ID NO: 299 and/or has a heavy chain comprising the amino acid sequence of SEQ ID NO: 300. In some embodiments, the meditope-enabled antibody or fragment comprises the cQFD meditope, the variant 1 linker, and/or is fused to cetuximab.

In some embodiments, the meditope-enabled antibody or fragment has a light chain comprising the amino acid sequence of SEQ ID NO: 301 and/or has a heavy chain comprising the amino acid sequence of SEQ ID NO: 302. In some embodiments, the meditope-enabled antibody or fragment comprises the cQFD meditope, the variant 3 linker, and/or is fused to cetuximab substituted as I83E (Kabat numbering), e.g., SEQ ID NO: 302.

The meditope-enabled antibodies generally further include a constant region, typically a heavy and light chain constant region, which generally are human or partially human constant regions. In some aspects, the heavy chain constant region includes a CH1, or a portion thereof. In some aspects, the light chain constant region includes a CL, or a portion thereof. In some embodiments, the portion of the constant region is sufficient to render the antibody capable of binding to the meditope, e.g., with the requisite binding affinity. In some aspects, the constant regions are the constant regions of cetuximab or trastuzumab. Thus, in some aspects, the heavy chain constant regions are one or more human IgG1 constant regions; in some aspects, the light chain constant regions are kappa constant chain regions. In other examples, the constant regions can include those of other isotypes, including human (or other organism, e.g., murine or chicken) IgG1, IgG2, IgG3, IgG4, IgEs, IgA1, IgA2, IgD, or IgM, and can include kappa or lambda constant regions. Thus, among the provided meditope-enabled antibodies are those generated by mutation of residues in other IgGs, such as human, murine, or chicken, or other immunoglobulins. In other words, the meditope-enabling methods provided herein may be used for any antibody, including IgA, IgE, IgD, and IgM and from any organism that produces antibodies including but not limited to chicken, murine, rat, bovine, rabbit, primates, and goat.

For example, the sequences of the first constant region (CH1) of a human IgG1, IgG2, IgG3, and IgG4 differ at residues that are not within the meditope-binding region of cetuximab, confirming that the meditope-enabling technology is applicable to isotypes other than the IgG1 of cetuximab. As another example, the sequence and structural alignment of an IgG1 and an IgE Fab domain indicates residues on the IgE near the meditope binding site.

The provided methods for meditope-site grafting of the Fab cavity within monoclonal antibodies can be used to create a unique handle for meditope binding and used with the technology previously disclosed and for newly-generated antibodies. In certain embodiments, the meditope binding site can be created on pre-existing and all future monoclonal antibodies.

Also provided are methods for modifying the meditope-enabled antibodies, for example, to alter various properties of the meditope-enabled antibodies, including aspects of the interaction with the meditopes, including affinity, avidity, pH-dependence, as well as other aspects, including pharmacokinetics (PK) and pharmacodynamics (PD) of the antibodies. Thus, also among the provided meditope-enabled antibodies are those modified antibodies generated according to those methods, e.g., by generating a pharmacophore binding model, including antibodies having any one or more of the modifications described in section F, below.

Also among the antibodies used as template antibodies to generate the meditope-enabled antibodies are modified antibodies and portions thereof, such as a CovX-Body™. Thus, among the provided meditope-enabled antibodies are CovX-bodies, modified to allow their binding to one or more of the provided meditopes, e.g., with an affinity as described herein.

Also provided are complexes containing one or more meditope bound to a meditope-enabled antibody, such as any of the antibodies described herein.

Also provided are nucleic acids, such as cDNA and RNA molecules, encoding the meditope-enabled antibodies, and vectors and libraries containing the same, as well as methods for their use, including selection and expression methods and methods for generating transgenic animals using such constructs.

The table below shows the sequences of additional linkers and meditope enabled antibodies which are referenced in the application.

| # | SEQUENCE | ANNOTATION |
|---|----------|------------|
| 254 | QIVLTQSPAIMSASPGEKVTITCSASSSISYMHWFQ QRTNGSPRLWIYTTSNLASGVPARFSGSGSGTSYSL TISRMEAEDEADYYCHQRSTYPLTFGAGTKLELKRT VAAPSVFIFPPSDEQLKSGTASVVCLLNNFYPREAK VQWKVDNALQSGNSQESVTEQDSKDSTYSLSSTLTL SKADYEKHKVYACEVTHQGLSSPVTKSFNRGEC | Anti-CD33 Light Chain |
| 255 | CQFDLSTRRLKCGGGAREEAAKAAEEAKKAAEEAAK AAQVQLQQSGAELAKPGASVKMSCKASGYTFTSYRM HWVKQSPGQGLEWIGYINPSTGYTEYNQKFKDKATL TADKSSSTAYMQLSSLTFEDSAIYYCARGGGVFDYW GQGTTLTVSSASTKGPSVFPLAPSSKSTSGGTAALG CLVKDYFPEPVTVSWNSGALTSGVHTFPAVLQSSGL YSLSSVVTVPSSSLGTQTYICNVNHKPSNTKVDKKV EPKSCDKTHTCPPCPAPELLGGPSVFLFPPKPKDTL MISRTPEVTCVVVDVSHEDPEVKFNWYVDGVEVHNA KTKPREEQYNSTYRVVSVLTVLHQDWLNGKEYKCKV SNKALPAPIEKTISKAKGQPREPQVYTLPPSRDELT KNQVSLTCLVKGFYPSDIAVEWESNGQPENNYKTTP PVLDSDGSFFLYSKLTVDKSRWQQGNVFSCSVMHEA LHNHYTQKSLSLSPGK | Anti-CD33 SnAP-body variant 1 heavy chain |
| 256 | CQFDLSTRRLKCGGGAAARAAAARAAAARAQVQLQQ SGAELAKPGASVKMSCKASGYTFTSYRMHWVKQSPG QGLEWIGYINPSTGYTEYNQKFKDKATLTADKSSST AYMQLSSLTFEDSAIYYCARGGGVFDYWGQGTTLTV SSASTKGPSVFPLAPSSKSTSGGTAALGCLVKDYFP EPVTVSWNSGALTSGVHTFPAVLQSSGLYSLSSVVT VPSSSLGTQTYICNVNHKPSNTKVDKKVEPKSCDKT HTCPPCPAPELLGGPSVFLFPPKPKDTLMISRTPEV TCVVVDVSHEDPEVKFNWYVDGVEVHNAKTKPREEQ YNSTYRVVSVLTVLHQDWLNGKEYKCKVSNKALPAP IEKTISKAKGQPREPQVYTLPPSRDELTKNQVSLTC LVKGFYPSDIAVEWESNGQPENNYKTTPPVLDSDGS FFLYSKLTVDKSRWQQGNVFSCSVMHEALHNHYTQK SLSLSPGK | Anti-CD33 SnAP-body variant 2 heavy chain |
| 257 | QVQLQQSGAELAKPGASVKMSCKASGYTFTSYRMHW VKQSPGQGLEWIGYINPSTGYTEYNQKFKDKATLTA DKSSSTAYMQLSSLTFEDSAIYYCARGGGVFDYWGQ GTTLTVSSASTKGPSVFPLAPSSKSTSGGTAALGCL VKDYFPEPVTVSWNSGALTSGVHTFPAVLQSSGLYS LSSVVTVPSSSLGTQTYICNVNHKPSNTKVDKKVEP | Control anti-CD33 heavy chain |

| # | SEQUENCE | ANNOTATION |
|---|---|---|
|  | KSCDKTHTCPPCPAPELLGGPSVFLFPPKPKDTLMI SRTPEVTCVVVDVSHEDPEVKFNWYVDGVEVHNAKT KPREEQYNSTYRVVSVLTVLHQDWLNGKEYKCKVSN KALPAPIEKTISKAKGQPREPQVYTLPPSRDELTKN QVSLTCLVKGFYPSDIAVEWESNGQPENNYKTTPPV LDSDGSFFLYSKLTVDKSRWQQGNVFSCSVMHEALH NHYTQKSLSLSPGK |  |
| 258 | QIVLTQSPAIMSASPGEKVTITCSASSSISYMHWFQ QKPGTSPKLWIYTTSNLASGVPARFSGSGSGTSYSL TISRMEAEDAATYYCHQRSTYPLTFGSGTKLELK | Meditope-enabled Gemtuzumab VL |
| 259 | DIQMTQSPSTLSASVGDRVTITCRASQSINTWLAWY QQKPGKAPKLLMYKASSLESGVPSRFIGSGSGTEFT LTISSLQPDDFATYYCQQYNSDSKMFGQGTKVEVK | Meditope-enabled Gemtuzumab VL |
| 260 | QVQLQQSGAELAKPGASVKMSCKASGYTFTSYRMHW VKQRPGQGLEWIGYINPSTGYTEYNQKFKDKATLTA DKSSSTAYMQLSSLTFEDSAVYYCARGGGVFDYWGQ GTTLTVSS | Meditope-enabled gemtuzumab VH |
| 261 | QVQLVQSGAEVKKPGSSVKVSCKASGGTFSRSAIIW VRQAPGQGLEWMGGIVPMFGPPNYAQKFQGRVTITA DESTNTAYMELSSLRSEDTAFYFCAGGYGIYSPEEY NGGLVTVSS | Meditope-enabled gemtuzumab VH |
| 262 | GGGAREEAAKAAEEAKKAAEEEAAKAA | Synthetic linker 1 |
| 263 | GGGAAARAAAARAAAARA | Synthetic linker 2 |
| 264 | GGGSKDEIDSAVK | Synthetic linker 3 |
| 265 | GGG | Flexible linker portion 1 |
| 266 | AREEAAKAAEEAKKAAEEEAAKAA | Rigid linker portion 1 |
| 267 | AAARAAAARAAAARA | Rigid linker portion 2 |
| 268 | SKDEIDSAVK | Rigid linker portion 3 |
| 269 | HSQGTFTSDYSKYLDSRRAQDFVQWLMNT | 1GCN glucagon |
| 270 | CGGREGVLKKLRAVENELHYNKSLLEEVKDELQKMRQL | Leucine zipper 1C94: A |
| 271 | GGREGVLKKLRAVENELHYNKSLLEEVKDELQKMRQL | Leucine zipper 1C94: A |
| 272 | MTTASTSQVRQNYHQDSEAAINRQINLELYASYVYL SMSYYFDRDDVALKNFAKYFLHQSHEEREHAEKLMK LQNQRGGRIFLQDIQKPDCDDWESGLNAMECALHLE KNVNQSLLELHKLATDKNDPHLCDFIETHYLNEQVK AIKELGDHVTNLRKMGAPESGLAEYLFDKHTLGDSD NES | Four helix bundle 1FHA |
| 273 | GLSDGEWQLVLNVWGKVEADIPGHGQEVLIRLFKGH PETLEKFDRFKHLKSEDEMKASEDLKKHGATVLTAL GGILKKKGHHEAEIKPLAQSHATKHKIPVKYLEFIS EAIIQVLQSKHPGDFGADAQGAMNKALELFRKDMAS NYKELGFQG | Myoglobin 3RGK |
| 274 | YAEAAKAAEEAAKAAEEAAKAF | EK peptide |
| 275 | CQFDLSTRRLKCGGGAREEAAKAAEEAKKAAEEAAK AAQVQLQQSGAELAKPGASVKMSCKASGYTFTSYRM HWVKQSPGQGLEWIGYINPSTGYTEYNQKFKDKATL TADKSSSTAYMQLSSLTFEDSAIYYCARGGGVFDYW GQGTTLTVSS | SnAP-body Variant 1 VH |
| 276 | QIVLTQSPAIMSASPGEKVTITCSASSSISYMHWFQ QRTNGSPRLWIYTTSNLASGVPARFSGSGSGTSYSL TISRMEAEDEADYYCHQRSTYPLTFGAGTKLELKRT VAAPSVFIFPPSDEQLKSGTASVVCLLNNFYPREAK VQWKVDNALQSGNSQESVTEQDSKDSTYSLSSTLTL SKADYEKHKVYACEVTHQGLSSPVTKSFNRGEC | Light chain of meditope enabled gemtuzumab |

| # | SEQUENCE | ANNOTATION |
|---|---|---|
| 277 | CQFDLSTRRLKCGGGAREEAAKAAEEAKKAAEEAAK AAQVQLQQSGAELAKPGASVKMSCKASGYTFTSYRM HWVKQSPGQGLEWIGYINPSTGYTEYNQKFKDKATL TADKSSSTAYMQLSSLTFEDSAIYYCARGGGVFDYW GQGTTLTVSSASTKGPSVFPLAPSSKSTSGGTAALG CLVKDYFPEPVTVSWNSGALTSGVHTFPAVLQSSGL YSLSSVVTVPSSSLGTQTYICNVNHKPSNTKVDKKV EPKSCDKTHTCPPCPAPELLGGPSVFLFPPKPKDTL MISRTPEVTCVVVDVSHEDPEVKFNWYVDGVEVHNA KTKPREEQYNSTYRVVSVLTVLHQDWLNGKEYKCKV SNKALPAPIEKTISKAKGQPREPQVYTLPPSRDELT KNQVSLTCLVKGFYPSDIAVEWESNGQPENNYKTTP PVLDSDGSFFLYSKLTVDKSRWQQGNVFSCSVMHEA LHNHYTQKSLSLSPGK | cQFD meditope, variant 1 linker, fused to the heavy chain of meditope enabled gemtuzumab |
| 278 | CQFDLSTRRLKCGGGAAARAAAARAAAARAQVQLQQ SGAELAKPGASVKMSCKASGYTFTSYRMHWVKQSPG QGLEWIGYINPSTGYTEYNQKFKDKATLTADKSSST AYMQLSSLTFEDSAIYYCARGGGVFDYWGQGTTLTV SSASTKGPSVFPLAPSSKSTSGGTAALGCLVKDYFP EPVTVSWNSGALTSGVHTFPAVLQSSGLYSLSSVVT VPSSSLGTQTYICNVNHKPSNTKVDKKVEPKSCDKT HTCPPCPAPELLGGPSVFLFPPKPKDTLMISRTPEV TCVVVDVSHEDPEVKFNWYVDGVEVHNAKTKPREEQ YNSTYRVVSVLTVLHQDWLNGKEYKCKVSNKALPAP IEKTISKAKGQPREPQVYTLPPSRDELTKNQVSLTC LVKGFYPSDIAVEWESNGQPENNYKTTPPVLDSDGS FFLYSKLTVDKSRWQQGNVFSCSVMHEALHNHYTQK SLSLSPGK | cQFD meditope, variant 2 linker, fused to the heavy chain of meditope enabled gemtuzumab |
| 279 | CQFDLSTRRLKCGGGSKDEIDSAVKQVQLQQSGAEL AKPGASVKMSCKASGYTFTSYRMHWVKQSPGQGLEW IGYINPSTGYTEYNQKFKDKATLTADKSSSTAYMQL SSLTFEDSAIYYCARGGGVFDYWGQGTTLTVSSAST KGPSVFPLAPSSKSTSGGTAALGCLVKDYFPEPVTV SWNSGALTSGVHTFPAVLQSSGLYSLSSVVTVPSSS LGTQTYICNVNHKPSNTKVDKKVEPKSCDKTHTCPP CPAPELLGGPSVFLFPPKPKDTLMISRTPEVTCVVV DVSHEDPEVKFNWYVDGVEVHNAKTKPREEQYNSTY RVVSVLTVLHQDWLNGKEYKCKVSNKALPAPIEKTI SKAKGQPREPQVYTLPPSRDELTKNQVSLTCLVKGF YPSDIAVEWESNGQPENNYKTTPPVLDSDGSFFLYS KLTVDKSRWQQGNVFSCSVMHEALHNHYTQKSLSLS PGK | cQFD meditope, variant 3 linker, fused to the heavy chain of meditope enabled gemtuzumab |
| 280 | CQFDLSTRRLKCGGGAREEAAKAAEEAKKAAEEAAK AAQVQLKQSGPGLVQPSQSLSITCTVSGFSLTNYGV HWVRQSPGKGLEWLGVIWSGGNTDYNTPFTSRLSIN KDNSKSQVFFKMNSLQSNDTAIYYCARALTYYDYEF AYWGQGTLVTVSAASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KRVEPKSCDKTHTCPPCPAPELLGGPSVFLFPPKPK DTLMISRTPEVTCVVVDVSHEDPEVKFNWYVDGVEV HNAKTKPREEQYNSTYRVVSVLTVLHQDWLNGKEYK CKVSNKALPAPIEKTISKAKGQPREPQVYTLPPSRD ELTKNQVSLTCLVKGFYPSDIAVEWESNGQPENNYK TTPPVLDSDGSFFLYSKLTVDKSRWQQGNVFSCSVM HEALHNHYTQKSLSLSPGK | cQFD meditope, variant 1 linker, fused to the heavy chain of I83E cetuximab |
| 281 | DIQMTQSPSILSASVGDRVTITCRASQDVNTAVAWY QQRTNKAPRLLIYSASFLYSGVPSRFSGSRSGTDFT LTISSLQPEDEADYYCQQHYTTPPTFGAGTKLEIKR TVAAPSVFIFPPSDEQLKSGTASVVCLLNNFYPREA KVQWKVDNALQSGNSQESVTEQDSKDSTYSLSSTLT LSKADYEKHKVYACEVTHQGLSSPVTKSFNRGEC | Meditope enabled trastuzumab light chain |
| 282 | CQFDLSTRRLKCGGGAREEAAKAAEEAKKAAEEAAK AAEVQLVESGGGLVQPGGSLRLSCAASGFNIKDTYI HWVRQSPGKGLEWVARIYPTNGYTRYADSVKGRFTI SADTSKNTAYLQMNSLRAEDTAIYYCSRWGGDGFYA MDYWGQGTLVTVSSASTKGPSVFPLAPSSKSTSGGT AALGCLVKDYFPEPVTVSWNSGALTSGVHTFPAVLQ SSGLYSLSSVVTVPSSSLGTQTYICNVNHKPSNTKV DKKVEPKSCDKTHTCPPCPAPELLGGPSVFLFPPKP KDILMISRTPEVTCVVVDVSHEDPEVKFNWYVDGVE VHNAKTKPREEQYNSTYRVVSVLTVLHQDWLNGKEY | cQFD meditope, variant 1 linker, fused to the heavy chain of meditope enabled trastuzumab |

-continued

| # | SEQUENCE | ANNOTATION |
|---|---|---|
| | KCKVSNKALPAPIEKTISKAKGQPREPQVYTLPPSR<br>EEMTKNQVSLTCLVKGFYPSDIAVEWESNGQPENNY<br>KTTPPVLDSDGSFFLYSKLTVDKSRWQQGNVFSCSV<br>MHEALHNHYTQKSLSLSPG | |
| 283 | DIQMTQSPSSLSASVGDRVTITCRASESVDNYGISF<br>MNWFQQKPGKAPKLLIYAASNQGSGVPSRFSGSGSG<br>TDFTLTISSLQPDDFATYYCQQSKEVPWTFGQGTKV<br>EIKRTVAAPSVFIFPPSDEQLKSGTASVVCLLNNFY<br>PREAKVQWKVDNALQSGNSQESVTEQDSKDSTYSLS<br>STLTLSKADYEKHKVYACEVTHQGLSSPVTKSFNRG<br>EC | Lintuzumab light chain |
| 284 | EVQLVQSGAEVKKPGSSVKVSCKASGYTFTDYNMHW<br>VRQAPGQGLEWIGYIYPYNGGTGYNQKFKSKATITA<br>DESTNTAYMELSSLRSEDTAVYYCARGRPAMDYWGQ<br>GTLVTVSSASTKGPSVFPLAPSSKSTSGGTAALGCL<br>VKDYFPEPVTVSWNSGALTSGVHTFPAVLQSSGLYS<br>LSSVVTVPSSSLGTQTYICNVNHKPSNTKVDKKVEP<br>KSCDKTHTCPPCPAPELLGGPSVFLFPPKPKDTLMI<br>SRTPEVTCVVVDVSHEDPEVKFNWYVDGVEVHNAKT<br>KPREEQYNSTYRVVSVLTVLHQDWLNGKEYKCKVSN<br>KALPAPIEKTISKAKGQPREPQVYTLPPSRDELTKN<br>QVSLTCLVKGFYPSDIAVEWESNGQPENNYKTTPPV<br>LDSDGSFFLYSKLTVDKSRWQQGNVFSCSVMHEALH<br>NHYTQKSLSLSPGK | Lintuzumab heavy chain |
| 285 | DIQMTQSPSILSASVGDRVTITCRASESVDNYGISF<br>MNWFQQRTNKAPRLLIYAASNQGSGVPSRFSGSGSG<br>TDFTLTISSLQPDDEADYYCQQSKEVPWTFGAGTKL<br>EIKRTVAAPSVFIFPPSDEQLKSGTASVVCLLNNFY<br>PREAKVQWKVDNALQSGNSQESVTEQDSKDSTYSLS<br>STLTLSKADYEKHKVYACEVTHQGLSSPVTKSFNRG<br>EC | Meditope-enabled lintuzumab light chain |
| 286 | DIQMTQSPSILSASVGDRVTITCRASESVDNYGISF<br>MNWFQQKTNKAPRLLIYAASNQGSGVPSRFSGSGSG<br>TDFTLTISSLQPDDEADYYCQQSKEVPWTFGAGTKL<br>EIKRTVAAPSVFIFPPSDEQLKSGTASVVCLLNNFY<br>PREAKVQWKVDNALQSGNSQESVTEQDSKDSTYSLS<br>STLTLSKADYEKHKVYACEVTHQGLSSPVTKSFNRG<br>EC | Meditope-enabled lintuzumab light chain, variant 1 |
| 287 | DIQMTQSPSILSASVGDRVTITCRASESVDNYGISF<br>MNWFQQRTNKAPRLLIYAASNQGSGVPSRFSGSGSG<br>TDFTLTISSLQPDDFATYYCQQSKEVPWTFGAGTKL<br>EIKRTVAAPSVFIFPPSDEQLKSGTASVVCLLNNFY<br>PREAKVQWKVDNALQSGNSQESVTEQDSKDSTYSLS<br>STLTLSKADYEKHKVYACEVTHQGLSSPVTKSFNRG<br>EC | Meditope-enabled lintuzumab light chain, variant 2 |
| 288 | DIQMTQSPSILSASVGDRVTITCRASESVDNYGISF<br>MNWFQQRTNGSPRLLIYAASNQGSGVPSRFSGSGSG<br>TDFTLTISSLQPDDIADYYCQQSKEVPWTFGAGTKL<br>EIKRTVAAPSVFIFPPSDEQLKSGTASVVCLLNNFY<br>PREAKVQWKVDNALQSGNSQESVTEQDSKDSTYSLS<br>STLTLSKADYEKHKVYACEVTHQGLSSPVTKSFNRG<br>EC | Meditope-enabled lintuzumab light chain, variant 3 |
| 289 | EVQLVQSGAEVKKPGSSVKVSCKASGYTFTDYNMHW<br>VRQSPGQGLEWIGYIYPYNGGTGYNQKFKSKATITA<br>DESTNTAYMELSSLRSEDTAIYYCARGRPAMDYWGQ<br>GTLVTVSSASTKGPSVFPLAPSSKSTSGGTAALGCL<br>VKDYFPEPVTVSWNSGALTSGVHTFPAVLQSSGLYS<br>LSSVVTVPSSSLGTQTYICNVNHKPSNTKVDKKVEP<br>KSCDKTHTCPPCPAPELLGGPSVFLFPPKPKDTLMI<br>SRTPEVTCVVVDVSHEDPEVKFNWYVDGVEVHNAKT<br>KPREEQYNSTYRVVSVLTVLHQDWLNGKEYKCKVSN<br>KALPAPIEKTISKAKGQPREPQVYTLPPSRDELTKN<br>QVSLTCLVKGFYPSDIAVEWESNGQPENNYKTTPPV<br>LDSDGSFFLYSKLTVDKSRWQQGNVFSCSVMHEALH<br>NHYTQKSLSLSPGK | Meditope-enabled lintuzumab heavy chain |
| 290 | <u>CQFDLSTRRLKCGGGAREEAAKAAEEAKKAAEEAAK</u><br><u>AA</u>EVQLVQSGAEVKKPGSSVKVSCKASGYTFTDYNM<br>HWVRQSPGQGLEWIGYIYPYNGGTGYNQKFKSKATI<br>TADESTNTAYMELSSLRSEDTAIYYCARGRPAMDYW | Meditope-enabled lintuzumab heavy chain, variant 1 |

| # | SEQUENCE | ANNOTATION |
|---|---|---|
| | GQGTLVTVSSASTKGPSVFPLAPSSKSTSGGTAALG CLVKDYFPEPVTVSWNSGALTSGVHTFPAVLQSSGL YSLSSVVTVPSSSLGTQTYICNVNHKPSNTKVDKKV EPKSCDKTHTCPPCPAPELLGGPSVFLFPPKPKDTL MISRTPEVTCVVVDVSHEDPEVKFNWYVDGVEVHNA KTKPREEQYNSTYRVVSVLTVLHQDWLNGKEYKCKV SNKALPAPIEKTISKAKGQPREPQVYTLPPSRDELT KNQVSLTCLVKGFYPSDIAVEWESNGQPENNYKTTP PVLDSDGSFFLYSKLTVDKSRWQQGNVFSCSVMHEA LHNHYTQKSLSLSPGK | |
| 291 | <u>*CQFDLSTRRLKC*</u>GGGAAARAAAARAAAARAEVQLVQ SGAEVKKPGSSVKVSCKASGYTFTDYNMHWVRQSPG QGLEWIGYIYPYNGGTYNQKFKSKATITADESTNT AYMELSSLRSEDTAIYYCARGRPAMDYWGQGTLVTV SSASTKGPSVFPLAPSSKSTSGGTAALGCLVKDYFP EPVTVSWNSGALTSGVHTFPAVLQSSGLYSLSSVVT VPSSSLGTQTYICNVNHKPSNTKVDKKVEPKSCDKT HTCPPCPAPELLGGPSVFLFPPKPKDTLMISRTPEV TCVVVDVSHEDPEVKFNWYVDGVEVHNAKTKPREEQ YNSTYRVVSVLTVLHQDWLNGKEYKCKVSNKALPAP IEKTISKAKGQPREPQVYTLPPSRDELTKNQVSLTC LVKGFYPSDIAVEWESNGQPENNYKTTPPVLDSDGS FFLYSKLTVDKSRWQQGNVFSCSVMHEALHNHYTQK SLSLSPGK | Meditope-enabled lintuzumab heavy chain, variant 2 |
| 292 | <u>*CQFDLSTRRLKC*</u>GGGSKDEIDSAVKEVQLVQSGAEV KKPGSSVKVSCKASGYTFTDYNMHWVRQSPGQGLEW IGYIYPYNGGTYNQKFKSKATITADESTNTAYMEL SSLRSEDTAIYYCARGRPAMDYWGQGTLVTVSSAST KGPSVFPLAPSSKSTSGGTAALGCLVKDYFPEPVTV SWNSGALTSGVHTFPAVLQSSGLYSLSSVVTVPSSS LGTQTYICNVNHKPSNTKVDKKVEPKSCDKTHTCPP CPAPELLGGPSVFLFPPKPKDTLMISRTPEVTCVVV DVSHEDPEVKFNWYVDGVEVHNAKTKPREEQYNSTY RVVSVLTVLHQDWLNGKEYKCKVSNKALPAPIEKTI SKAKGQPREPQVYTLPPSRDELTKNQVSLTCLVKGF YPSDIAVEWESNGQPENNYKTTPPVLDSDGSFFLYS KLTVDKSRWQQGNVFSCSVMHEALHNHYTQKSLSLS PGK | Meditope-enabled lintuzumab heavy chain, variant 3 |
| 293 | QIVLTQSPAIMSASPGEKVTITCSASSSISYMHWFQ QRTNGSPRLWIYTTSNLASGVPARFSGSGSGTSYSL TISRMEAEDEADYYCHQRSTYPLTFGAGTKLELKRT VAAPSVFIFPPSDEQLKSGTASVVCLLNNFYPREAK VQWKVDNALQSGNSQESVTEQDSKDSTYSLSSTLTL SKADYEKHKVYACEVTHQGLSSPVTKSFNRGEC | Light chain of CD33-SnAPbody MB-005-101 |
| 294 | <u>*CQFDLSTRRLKC*</u>GGGAREEAAKAAEEAKKAAEEAAK AAQVQLQQSGAELAKPGASVKMSCKASGYTFTSYRM HWVKQSPGQGLEWIGYINPSTGYTEYNQKFKDKATL TADKSSSTAYMQLSSLTFEDSAIYYCARGGGVFDYW GQGTTLTVSSASTKGPSVFPLAPSSKSTSGGTAALG CLVKDYFPEPVTVSWNSGALTSGVHTFPAVLQSSGL YSLSSVVTVPSSSLGTQTYICNVNHKPSNTKVDKKV EPKSCDKTHTCPPCPAPELLGGPSVFLFPPKPKDTL MISRTPEVTCVVVDVSHEDPEVKFNWYVDGVEVHNA KTKPREEQYNSTYRVVSVLTVLHQDWLNGKEYKCKV SNKALPAPIEKTISKAKGQPREPQVYTLPPSRDELT KNQVSLTCLVKGFYPSDIAVEWESNGQPENNYKTTP PVLDSDGSFFLYSKLTVDKSRWQQGNVFSCSVMHEA LHNHYTQKSLSLSPGK | Heavy chain of CD33-SnAPbody MB-005-101. The cQFD meditope (italic and underlined) and variant 1 linker (bold) are fused to the heavy chain of meditope enabled gemtuzumab |
| 295 | QIVLTQSPAIMSASPGEKVTITCSASSSISYMHWFQ QRTNGSPRLWIYTTSNLASGVPARFSGSGSGTSYSL TISRMEAEDEADYYCHQRSTYPLTFGAGTKLELKRT VAAPSVFIFPPSDEQLKSGTASVVCLLNNFYPREAK VQWKVDNALQSGNSQESVTEQDSKDSTYSLSSTLTL SKADYEKHKVYACEVTHQGLSSPVTKSFNRGEC | Light chain of CD33-SnAPbody MB-005-102 |
| 296 | <u>*CQFDLSTRRLKC*</u>GGGAAARAAAARAAAARAQVQLQQ SGAELAKPGASVKMSCKASGYTFTSYRMHWVKQSPG QGLEWIGYINPSTGYTEYNQKFKDKATLTADKSSST AYMQLSSLTFEDSAIYYCARGGGVFDYWGQGTTLTV SSASTKGPSVFPLAPSSKSTSGGTAALGCLVKDYFP EPVTVSWNSGALTSGVHTFPAVLQSSGLYSLSSVVT VPSSSLGTQTYICNVNHKPSNTKVDKKVEPKSCDKT | Heavy chain of CD33-SnAPbody MB-005-102. The cQFD meditope (italic and underlined) and variant 2 linker (bold) are fused to the heavy chain of meditope enabled gemtuzumab |

| # | SEQUENCE | ANNOTATION |
|---|---|---|
| | HTCPPCPAPELLGGPSVFLFPPKPKDTLMISRTPEV<br>TCVVVDVSHEDPEVKFNWYVDGVEVHNAKTKPREEQ<br>YNSTYRVVSVLTVLHQDWLNGKEYKCKVSNKALPAP<br>IEKTISKAKGQPREPQVYTLPPSRDELTKNQVSLTC<br>LVKGFYPSDIAVEWESNGQPENNYKTTPPVLDSDGS<br>FFLYSKLTVDKSRWQQGNVFSCSVMHEALHNHYTQK<br>SLSLSPGK | |
| 297 | QIVLTQSPAIMSASPGEKVTITCSASSSISYMHWFQ<br>QRTNGSPRLWIYTTSNLASGVPARFSGSGSGTSYSL<br>TISRMEAEDEADYYCHQRSTYPLTFGAGTKLELKRT<br>VAAPSVFIFPPSDEQLKSGTASVVCLLNNFYPREAK<br>VQWKVDNALQSGNSQESVTEQDSKDSTYSLSSTLTL<br>SKADYEKHKVYACEVTHQGLSSPVTKSFNRGEC | Light chain of CD33-<br>SnAPbody MB-005-103 |
| 298 | *CQFDLSTRRLKC*GGGSKDEIDSAVKQVQLQQSGAEL<br>AKPGASVKMSCKASGYTFTSYRMHWVKQSPGQGLEW<br>IGYINPSTGYTEYNQKFKDKATLTADKSSSTAYMQL<br>SSLTFEDSAIYYCARGGGVFDYWGQGTTLTVSSAST<br>KGPSVFPLAPSSKSTSGGTAALGCLVKDYFPEPVTV<br>SWNSGALTSGVHTFPAVLQSSGLYSLSSVVTVPSSS<br>LGTQTYICNVNHKPSNTKVDKKVEPKSCDKTHTCPP<br>CPAPELLGGPSVFLFPPKPKDTLMISRTPEVTCVVV<br>DVSHEDPEVKFNWYVDGVEVHNAKTKPREEQYNSTY<br>RVVSVLTVLHQDWLNGKEYKCKVSNKALPAPIEKTI<br>SKAKGQPREPQVYTLPPSRDELTKNQVSLTCLVKGF<br>YPSDIAVEWESNGQPENNYKTTPPVLDSDGSFFLYS<br>KLTVDKSRWQQGNVFSCSVMHEALHNHYTQKSLSLS<br>PGK | Heavy chain of CD33-<br>SnAPbody MB-005-103. The<br>cQFD meditope (italic and<br>underlined) and variant 3<br>linker (bold) are fused to the<br>heavy chain of meditope<br>enabled gemtuzumab |
| 299 | DILLTQSPVILSVSPGERVSFSCRASQSIGTNIHWY<br>QQRTNGSPRLLIKYASESISGIPSRFSGSGSGTDFT<br>LSINSVESEDIADYYCQQNNNWPTTFGAGTKLELKR<br>TVAAPSVFIFPPSDEQLKSGTASVVCLLNNFYPREA<br>KVQWKVDNALQSGNSQESVTEQDSKDSTYSLSSTLT<br>LSKADYEKHKVYACEVTHQGLSSPVTKSFNRGEC | Light chain of EGFR-<br>SnAPbody MB005-104 |
| 300 | *CQFDLSTRRLKC*GGGAREEAAKAAEEEAKKAAEEAAK<br>AAQVQLKQSGPGLVQPSQSLSITCTVSGFSLTNYGV<br>HWVRQSPGKGLEWLGVIWSGGNTDYNTPFTSRLSIN<br>KDNSKSQVFFKMNSLQSNDTAIYYCARALTYYDYEF<br>AYWGQGTLVTVSAASTKGPSVFPLAPSSKSTSGGTA<br>ALGCLVKDYFPEPVTVSWNSGALTSGVHTFPAVLQS<br>SGLYSLSSVVTVPSSSLGTQTYICNVNHKPSNTKVD<br>KRVEPKSCDKTHTCPPCPAPELLGGPSVFLFPPKPK<br>DTLMISRTPEVTCVVVDVSHEDPEVKFNWYVDGVEV<br>HNAKTKPREEQYNSTYRVVSVLTVLHQDWLNGKEYK<br>CKVSNKALPAPIEKTISKAKGQPREPQVYTLPPSRD<br>ELTKNQVSLTCLVKGFYPSDIAVEWESNGQPENNYK<br>TTPPVLDSDGSFFLYSKLTVDKSRWQQGNVFSCSVM<br>HEALHNHYTQKSLSLSPGK | Heavy chain of EGFR-<br>SnAPbody MB005-104. The<br>cQFD meditope (italic and<br>underlined) and variant 1<br>linker (bold) are fused to the<br>heavy chain of cetuximab |
| 301 | DILLTQSPVILSVSPGERVSFSCRASQSIGTNIHWY<br>QQRTNGSPRLLIKYASESISGIPSRFSGSGSGTDFT<br>LSINSVESEDEADYYCQQNNNWPTTFGAGTKLELKR<br>TVAAPSVFIFPPSDEQLKSGTASVVCLLNNFYPREA<br>KVQWKVDNALQSGNSQESVTEQDSKDSTYSLSSTLT<br>LSKADYEKHKVYACEVTHQGLSSPVTKSFNRGEC | Light chain of EGFR-<br>SnAPbody MB005-105 |
| 302 | *CQFDLSTRRLKC*GGGAREEAAKAAEEEAKKAAEEAAK<br>AAQVQLKQSGPGLVQPSQSLSITCTVSGFSLTNYGV<br>HWVRQSPGKGLEWLGVIWSGGNTDYNTPFTSRLSIN<br>KDNSKSQVFFKMNSLQSNDTAIYYCARALTYYDYEF<br>AYWGQGTLVTVSAASTKGPSVFPLAPSSKSTSGGTA<br>ALGCLVKDYFPEPVTVSWNSGALTSGVHTFPAVLQS<br>SGLYSLSSVVTVPSSSLGTQTYICNVNHKPSNTKVD<br>KRVEPKSCDKTHTCPPCPAPELLGGPSVFLFPPKPK<br>DTLMISRTPEVTCVVVDVSHEDPEVKFNWYVDGVEV<br>HNAKTKPREEQYNSTYRVVSVLTVLHQDWLNGKEYK<br>CKVSNKALPAPIEKTISKAKGQPREPQVYTLPPSRD<br>ELTKNQVSLTCLVKGFYPSDIAVEWESNGQPENNYK<br>TTPPVLDSDGSFFLYSKLTVDKSRWQQGNVFSCSVM<br>HEALHNHYTQKSLSLSPGK | Heavy chain of EGFR-<br>SnAPbody MB005-105. The<br>cQFD meditope (italic and<br>underlined) and variant 3<br>linker (bold) are fused to the<br>heavy chain of I83E cetuximab |
| 303 | DIQMTQSPSILSASVGDRVTITCRASQDVNTAVAWY<br>QQRTNKAPRLLIYSASFLYSGVPSRFSGSRSGTDFT<br>LTISSLQPEDEADYYCQQHYTTPPTFGAGTKLEIKR | Light chain of HER2-<br>SnAPbody MB005-106 |

| # | SEQUENCE | ANNOTATION |
|---|---|---|
|  | TVAAPSVFIFPPSDEQLKSGTASVVCLLNNFYPREA KVQWKVDNALQSGNSQESVTEQDSKDSTYSLSSTLT LSKADYEKHKVYACEVTHQGLSSPVTKSFNRGEC |  |
| 304 | *CQFDLSTRRLKC*GGGAREEAAKAAEEAKKAAEEAAK AAEVQLVESGGGLVQPGGSLRLSCAASGFNIKDTYI HWVRQSPGKGLEWVARIYPTNGYTRYADSVKGRFTI SADTSKNTAYLQMNSLRAEDTAIYYCSRWGGDGFYA MDYWGQGTLVTVSSASTKGPSVFPLAPSSKSTSGGT AALGCLVKDYFPEPVTVSWNSGALTSGVHTFPAVLQ SSGLYSLSSVVTVPSSSLGTQTYICNVNHKPSNTKV DKKVEPKSCDKTHTCPPCPAPELLGGPSVFLFPPKP KDILMISRTPEVTCVVVDVSHEDPEVKFNWYVDGVE VHNAKTKPREEQYNSTYRVVSVLTVLHQDWLNGKEY KCKVSNKALPAPIEKTISKAKGQPREPQVYTLPPSR EEMTKNQVSLTCLVKGFYPSDIAVEWESNGQPENNY KTTPPVLDSDGSFFLYSKLTVDKSRWQQGNVFSCSV MHEALHNHYTQKSLSLSPG | Heavy chain of HER2-SnAPbody MB005-106. The cQFD meditope (italic and underlined) and variant 3 linker (bold) are fused to the heavy chain of meditope enabled trastuzumab |
| 305 | EIVLTQSPVILSASPGERVTITCSASSGVNYMHWYQ QRTNGSPKRWIYDTSKLASGVPARFSGSGSGTDYSL TISSMEPEDEADYYCHQRGSYTFGGGTKLEIKRTVA APSVFIFPPSDEQLKSGTASVVCLLNNFYPREAKVQ WKVDNALQSGNSQESVTEQDSKDSTYSLSSTLTLSK ADYEKHKVYACEVTHQGLSSPVTKSFNRGEC | Light chain of CD19-SnAPbody MB005-107 |
| 306 | *CQFDLSTRRLKC*GGGAREEAAKAAEEAKKAAEEAAK AAQVQLVQPGAEVVKPGASVKLSCKTSGYTFTSNWM HWVKQSPGQGLEWIGEIDPSDSYTNYNQNFQGKAKL TVDKSTSTAYMEVSSLRSDDTAIYYCARGSNPYYYA MDYWGQGTSVTVSSASTKGPSVFPLAPSSKSTSGGT AALGCLVKDYFPEPVTVSWNSGALTSGVHTFPAVLQ SSGLYSLSSVVTVPSSSLGTQTYICNVNHKPSNTKV DKKVEPKSCDKTHTCPPCPAPELLGGPSVFLFPPKP KDILMISRTPEVTCVVVDVSHEDPEVKFNWYVDGVE VHNAKTKPREEQYNSTYRVVSVLTVLHQDWLNGKEY KCKVSNKALPAPIEKTISKAKGQPREPQVYTLPPSR DELTKNQVSLTCLVKGFYPSDIAVEWESNGQPENNY KITPPVLDSDGSFFLYSKLTVDKSRWQQGNVFSCSV MHEALHNHYTQKSLSLSPGK | Heavy chain of CD19-SnAPbody MB005-107. The cQFD meditope (italic and underlined) and variant 3 linker (bold) are fused to the heavy chain of meditope enabled anti CD19 antibody |

II. COMPOSITIONS AND METHODS FOR GENERATING SELF-CROSSLINKING ANTIBODIES

A. Nucleic Acids, Vectors, and Cells Comprising the Same

Also provided are isolated nucleic acids encoding any of the antibodies described herein. In some embodiments, the nucleic acid further comprises a vector suitable for expression of the nucleic acid encoding any of the previously described self-crosslinking antibodies. In a still further specific aspect, the vector is in a host cell suitable for expression of the nucleic acid. In a still further specific aspect, the host cell is a eukaryotic cell or a prokaryotic cell. In a still further specific aspect, the eukaryotic cell is a mammalian cell, such as Chinese Hamster Ovary (CHO) or HEK-293 and variants thereof.

In some embodiments, the nucleic acid further comprises a sequence of nucleotides encoding a free meditope. In some embodiments, a first nucleic acid comprises the sequence of nucleotides encoding the self-crosslinking antibody and a second nucleic acid comprises a sequence of nucleotides encoding the free meditope. The free meditope can comprise any of the cyclic peptides described herein, including, for example any of SEQ ID NO: 1, 2, 15, 16, 17, 18, 19, 20, 21, 22, 23, 24, 25, 26, 27, 28, 29, 30, 31, 32, 34, 35, 36, 37, 38, 39, 40, 41, 42, 43, 44, 45, 46, 47, 48, 49, 50, 51, 52, 53, 54, 55, 186, 187, 188, 189, or 207, or a cyclic peptide derived therefrom. In some embodiments, the free meditope is capable of binding a meditope binding site on the self-crosslinking antibody encoded by the nucleic acid.

The antibody or antigen binding fragment thereof, may be made using methods known in the art, for example, by a process comprising culturing a host cell containing nucleic acid encoding any of the previously described self-crosslinking antibodies or antigen-binding fragments in a form suitable for expression, under conditions suitable to produce such antibody or fragment, and recovering the antibody or fragment.

In some embodiments, self-crosslinking antibodies can be produced using recombinant methods. For recombinant production of an anti-antigen antibody, a nucleic acid encoding the antibody can be isolated and inserted into a replicable vector for further cloning (amplification of the DNA) or for expression. DNA encoding the antibody may be readily isolated and sequenced using conventional procedures (e.g., by using oligonucleotide probes that are capable of binding specifically to genes encoding the heavy and light chains of the antibody). Many vectors are available, including, for example the pCEP4 vector, a viral vector, a retroviral vector, a lentiviral vector, or a gamma retroviral vector. The vector components generally include, but are not limited to, one or more of the following: a signal sequence, an origin of replication, one or more marker genes, an enhancer element, a promoter, and a transcription termination sequence.

1. Polycistronic Expression Vectors

In some embodiments, the expression vector is a bicistronic, tricistronic, or polycistronic vector (also called a multicistronic vector) capable of co-expressing both the self-crosslinking antibody and the free meditope. In some embodiments, the sequence of nucleotides encoding the free meditope and the sequence of nucleotides encoding the self-crosslinking antibody are operatively linked or separated by a sequence of nucleotides encoding a self-cleaving peptide. In some embodiments, they are separated by a sequence of nucleotides encoding a peptide that causes ribosome skipping, such as a picornavirus 2A ribosomal skip peptide or T2A peptide.

In some embodiments, the series of nucleic acids encoding the free meditope and the series of nucleic acids encoding the self-crosslinking antibody are operatively linked or separated by an internal ribosome entry site (IRES). In some embodiments, the gene before the IRES sequence is expressed at higher levels than the gene after the IRES sequence. It may be advantageous in some embodiments to place the sequence of nucleotides encoding the free meditope before the IRES sequence and the sequence of nucleotides encoding the self-crosslinking antibody after the IRES sequence. This arrangement can allow for the expression of an excess of free-meditope peptide compared to self-crosslinking antibody, thereby reducing or preventing the antibodies from self-crosslinking during production, isolation, and/or during storage.

2. Signal Sequence Component

In some embodiments, a self-crosslinking antibody may be produced recombinantly not only directly, but also as a fusion polypeptide with a heterologous polypeptide, which can be a signal sequence or other polypeptide having a specific cleavage site at the N-terminus of the mature protein or polypeptide. The heterologous signal sequence selected preferably is one that is recognized and processed (e.g., cleaved by a signal peptidase) by the host cell. For prokaryotic host cells that do not recognize and process a native antibody signal sequence, the signal sequence is substituted by a prokaryotic signal sequence selected, for example, from the group of the alkaline phosphatase, penicillinase, lpp, or heat-stable enterotoxin II leaders. For yeast secretion, the native signal sequence may be substituted by, e.g., the yeast invertase leader, a factor leader (including *Saccharomyces* and *Kluyveromyces* a-factor leaders), or acid phosphatase leader, the *C. albicans* glucoamylase leader, or the signal described in WO 90/13646. In mammalian cell expression, mammalian signal sequences as well as viral secretory leaders, for example, the herpes simplex gD signal, are available.

3. Origin of Replication

Both expression and cloning vectors generally contain a nucleic acid sequence that enables the vector to replicate in one or more selected host cells. In cloning vectors this sequence can be one that enables the vector to replicate independently of the host chromosomal DNA, and can include origins of replication or autonomously replicating sequences. Such sequences are well known for a variety of bacteria, yeast, and viruses. The origin of replication from the plasmid pBR322 is suitable for most Gram-negative bacteria, the 2μ plasmid origin is suitable for yeast, and various viral origins (SV40, polyoma, adenovirus, VSV or BPV) are useful for cloning vectors in mammalian cells. Generally, the origin of replication component is not needed for mammalian expression vectors, although the SV40 origin may be used because it contains the early promoter.

4. Selection Component

Expression and cloning vectors may contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

One example of a selection scheme utilizes a drug to arrest growth of a host cell. Those cells that are successfully transformed with a heterologous gene produce a protein conferring drug resistance and thus survive the selection regimen. Examples of such dominant selection use the drugs neomycin, mycophenolic acid and hygromycin.

Another example of suitable selectable markers for mammalian cells are those that enable the identification of cells competent to take up antibody-encoding nucleic acid, such as DHFR, glutamine synthetase (GS), thymidine kinase, metallothionein-I and -II, preferably primate metallothionein genes, adenosine deaminase, ornithine decarboxylase, etc.

For example, cells transformed with the DHFR gene are identified by culturing the transformants in a culture medium containing methotrexate (Mtx), a competitive antagonist of DHFR. Under these conditions, the DHFR gene is amplified along with any other co-transformed nucleic acid. A Chinese hamster ovary (CHO) cell line deficient in endogenous DHFR activity (e.g., ATCC CRL-9096) may be used.

Alternatively, cells transformed with the GS gene are identified by culturing the transformants in a culture medium containing L-methionine sulfoximine (Msx), an inhibitor of GS. Under these conditions, the GS gene is amplified along with any other co-transformed nucleic acid. The GS selection/amplification system may be used in combination with the DHFR selection/amplification system described above.

Alternatively, host cells (particularly wild-type hosts that contain endogenous DHFR) transformed or co-transformed with DNA sequences encoding an antibody of interest, wild-type DHFR gene, and another selectable marker such as aminoglycoside 3'-phosphotransferase (APH) can be selected by cell growth in medium containing a selection agent for the selectable marker such as an aminoglycosidic antibiotic, e.g., kanamycin, neomycin, or G418. See U.S. Pat. No. 4,965,199.

A suitable selection gene for use in yeast is the trp1 gene present in the yeast plasmid YRp7 (Stinchcomb et al., *Nature*, 282:39 (1979)). The trp1 gene provides a selection marker for a mutant strain of yeast lacking the ability to grow in tryptophan, for example, ATCC No. 44076 or PEP4-1. Jones, Genetics, 85:12 (1977). The presence of the trp1 lesion in the yeast host cell genome then provides an effective environment for detecting transformation by growth in the absence of tryptophan. Similarly, Leu2-deficient yeast strains (ATCC 20,622 or 38,626) are complemented by known plasmids bearing the Leu2 gene.

In addition, vectors derived from the 1.6 μm circular plasmid pKD1 can be used for transformation of *Kluyveromyces* yeasts. Alternatively, an expression system for large-scale production of recombinant calf chymosin was reported for *K. lactis*. Van den Berg, *Bio/Technology*, 8:135 (1990). Stable multi-copy expression vectors for secretion of mature recombinant human serum albumin by industrial strains of *Kluyveromyces* have also been disclosed. Fleer et al., *Bio/Technology*, 9:968-975 (1991).

5. Promoter Component

Expression and cloning vectors generally contain a promoter that is recognized by the host organism and is operably linked to nucleic acid encoding an antibody. In some embodiments, the vector comprises one promoter controlling transcription of the self-crosslinking antibody. In some embodiments, the vector comprises one promoter operatively linked to a sequence of nucleic acids encoding both the self-crosslinking antibody and one or more free meditopes. In another embodiment, the vector comprises a sequence of nucleotides encoding the recombinant meditope enabled antibody or antigen binding fragment thereof that is operatively linked to a first promoter and a sequence of nucleotides encoding the free meditope that is operatively linked to a second promoter. The first and second promoters can be the same or different.

In some embodiments, it may be advantageous to express the free meditope and the self-crosslinking antibody at different levels. For example, it may be advantageous to express the free meditope at higher levels than the self-crosslinking antibody to prevent self-crosslinking during production, isolation, or storage. Thus, in some embodiments, one promoter might be a stronger promoter, may lead to a higher rate of transcription initiation, or has a higher affinity for RNA polymerase than the other. In some embodiments, one or both of the promoters are conditional promoters.

Promoters suitable for use with prokaryotic hosts include the phoA promoter, β-lactamase and lactose promoter systems, alkaline phosphatase promoter, a tryptophan (trp) promoter system, and hybrid promoters such as the tac promoter. However, other known bacterial promoters are suitable. Promoters for use in bacterial systems can contain a Shine-Dalgarno (S.D.) sequence operably linked to the DNA encoding an antibody.

Promoter sequences are known for eukaryotes. Virtually all eukaryotic genes have an AT-rich region located approximately 25 to 30 bases upstream from the site where transcription is initiated. Another sequence found 70 to 80 bases upstream from the start of transcription of many genes is a CNCAAT region where N may be any nucleotide. At the 3' end of most eukaryotic genes is an AATAAA sequence that may be the signal for addition of the poly A tail to the 3' end of the coding sequence. All of these sequences are suitably inserted into eukaryotic expression vectors.

Examples of suitable promoter sequences for use with yeast hosts include the promoters for 3-phosphoglycerate kinase or other glycolytic enzymes, such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657. Yeast enhancers also are advantageously used with yeast promoters.

Antibody transcription from vectors in mammalian host cells can be controlled, for example, by promoters obtained from the genomes of viruses such as polyoma virus, fowlpox virus, adenovirus (such as Adenovirus 2), bovine papilloma virus, avian sarcoma virus, cytomegalovirus (CMV), a retrovirus, hepatitis-B virus, Simian Virus 40 (SV40), or from heterologous mammalian promoters, e.g., the actin promoter or an immunoglobulin promoter, from heat-shock promoters, provided such promoters are compatible with the host cell systems.

The early and late promoters of the SV40 virus are conveniently obtained as an SV40 restriction fragment that also contains the SV40 viral origin of replication. The immediate early promoter of the human cytomegalovirus is conveniently obtained as a HindIII E restriction fragment. A system for expressing DNA in mammalian hosts using the bovine papilloma virus as a vector is disclosed in U.S. Pat. No. 4,419,446. A modification of this system is described in U.S. Pat. No. 4,601,978. See also Reyes et al., Nature 297:598-601 (1982) on expression of human β-interferon cDNA in mouse cells under the control of a thymidine kinase promoter from herpes simplex virus. Alternatively, the Rous Sarcoma Virus long terminal repeat, PGK, EF1α, NSE, UBC, CAGG, synapsin, β-actin, or GFAP can be used as the promoter.

In some embodiments, the expression is under the control of a conditional promoter, enhancer or transactivator. In some embodiments, expression of the self-crosslinking antibody is under the control of a conditional promoter, enhancer, or transactivator and expression of the free meditope is under the control of a constitutively active promoter. As an exemplary advantage, such embodiments can allow for the control of the amount of self-crosslinking antibody produced, the timing of expression, and the ratio of self-crosslinking antibody and free meditope. In some embodiments, expression of the self-crosslinking antibody is under the control of a constitutively active promoter, enhancer, or transactivator and expression of the free meditope is under the control of a conditional promoter. As an exemplary advantage, such embodiments can allow for expression of the free meditope only when necessary to modulate antibody self-crosslinking during production, isolation, or storage. In some embodiments, the conditional promoter, enhancer or transactivator is an inducible promoter, enhancer or transactivator, a repressible promoter, enhancer or transactivator, or a tissue-specific promoter, enhancer or transactivator.

In some embodiments, expression of any of the peptides or nucleic acids described herein may be externally controlled by treating the cell with a modulating factor, such as doxycycline, tetracycline or analogues thereof. Analogues of tetracycline include, for example, chlortetracycline, oxytetracycline, demethylchloro-tetracycline, methacycline, doxycycline and minocycline.

In some embodiments, inducible transcription and/or expression can be implemented using a transactivator together with a transactivator induced promoter. In some embodiments, such a transactivator induced promoter comprises control elements for the enhancement or repression of transcription of the transgene or nucleic acid of interest. Control elements include, without limitation, operators, enhancers and promoters. In some embodiments, a transactivator inducible promoter is transcriptionally active when bound to a transactivator, which in turn is activated under a specific set of conditions, for example, in the presence or in the absence of a particular combination of chemical signals, for example, by a modulating factor selected for example from the previous list.

The transactivator induced promoter may be any promoter herein mentioned which has been modified to incorporate transactivator binding sequences, such as several tet-operon sequences, for example 3, 4, 5, 6, 7, 8, 9, or 10 tet-operon sequences. In some embodiments, the tet-operon sequences are in tandem.

Specific examples of transcription modulator domains that induce expression in the presence of modulating factor include, but are not limited to, the transcription modulator domains found in the following transcription modulators:

the Tet-On transcription modulator; and the Tet-On Advanced transcription modulator and the Tet-On 3G transcription modulator; all of which are available from Clontech Laboratories, Mountain View, Calif. Specific examples of transcription modulator domains that induce expression in the absence of modulating factor include, but are not limited to, the transcription modulator domains found in the following transcription modulators: the Tet-off transcription modulator and the Tet-Off Advanced transcription modulator, both of which are available from Clontech Laboratories, Mountain View, Calif. These systems can be adapted and used according to procedures that are well known in the art and that will be familiar to the ordinarily skilled artisan.

In some embodiments, the transactivator induced promoter comprises a plurality of transactivator binding sequences operatively linked to the inhibitory nucleic acid molecule.

The transactivator may be provided by a nucleic acid sequence, in the same expression vector or in a different expression vector, comprising a modulating factor-dependent promoter operatively linked to a sequence encoding the transactivator. The term "different expression vector" is intended to include any vehicle for delivery of a nucleic acid, for example, a virus, plasmid, cosmid or transposon. Suitable promoters for use in said nucleic acid sequence include, for example, constitutive, regulated, tissue-specific or ubiquitous promoters, which may be of cellular, viral or synthetic origin, such as CMV, RSV, PGK, EF1α, NSE, synapsin, β-actin, GFAP.

An exemplary transactivator according to some embodiments is the rtTA-Oct.2 transactivator composed of the DNA binding domain of rtTA2-M2 and of the Oct-2Q(Q→A) activation domain. Another exemplary transactivator according to some embodiments is the rtTA-Oct.3 transactivator composed of the DNA binding domain of the Tet-repressor protein (*E. coli*) and of the Oct-2Q(Q→A) activation domain. Both are described in patent application WO 2007/004062.

6. Enhancer Element Component

Transcription of a DNA encoding an antibody of this invention by higher eukaryotes is often increased by inserting an enhancer sequence into the vector. Many enhancer sequences are now known from mammalian genes (globin, elastase, albumin, a-fetoprotein, and insulin). Typically, however, one will use an enhancer from a eukaryotic cell virus. Examples include the SV40 enhancer on the late side of the replication origin (bp 100-270), the cytomegalovirus early promoter enhancer, the polyoma enhancer on the late side of the replication origin, and adenovirus enhancers. See also Yaniv, *Nature* 297:17-18 (1982) on enhancing elements for activation of eukaryotic promoters. The enhancer may be spliced into the vector at a position 5' or 3' to the antibody-encoding sequence, but is preferably located at a site 5' from the promoter.

7. Transcription Termination Component

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding antibody. One useful transcription termination component is the bovine growth hormone polyadenylation region. See WO94/11026 and the expression vector disclosed therein.

8. Selection and Transformation of Host Cells

Suitable host cells for cloning or expressing the DNA in the vectors herein are the prokaryote, yeast, or higher eukaryote cells described above. Suitable prokaryotes for this purpose include eubacteria, such as Gram-negative or Gram-positive organisms, for example, Enterobacteriaceae such as *Escherichia*, e.g., *E. coli*, *Enterobacter*, *Envinia*, *Klebsiella*, *Proteus*, *Salmonella*, e.g., *Salmonella typhimurium*, *Serratia*, e.g., *Serratia marcescans*, and *Shigella*, as well as Bacilli such as *B. subtilis* and *B. licheniformis* (e.g., *B. licheniformis* 41P disclosed in DD 266,710 published 12 Apr. 1989), *Pseudomonas* such as *P. aeruginosa*, and *Streptomyces*. One preferred *E. coli* cloning host is *E. coli* 294 (ATCC 31,446), although other strains such as *E. coli* B, *E. coli* X1776 (ATCC 31,537), and *E. coli* W3110 (ATCC 27,325) are suitable. These examples are illustrative rather than limiting.

Full length antibody, antibody fusion proteins, and antibody fragments can be produced in bacteria, in particular when glycosylation and Fc effector function are not needed, such as when the therapeutic antibody is conjugated to a cytotoxic agent (e.g., a toxin) that by itself shows effectiveness in tumor cell destruction. Full length antibodies have greater half-life in circulation. Production in *E. coli* is faster and more cost efficient. For expression of antibody fragments and polypeptides in bacteria, see, e.g., U.S. Pat. No. 5,648,237 (Carter et. al.), U.S. Pat. No. 5,789,199 (Joly et al.), U.S. Pat. No. 5,840,523 (Simmons et al.), which describes translation initiation region (TIR) and signal sequences for optimizing expression and secretion. See also Charlton, *Methods in Molecular Biology*, Vol. 248 (B. K. C. Lo, ed., Humana Press, Totowa, N.J., 2003), pp. 245-254, describing expression of antibody fragments in *E. coli*. After expression, the antibody may be isolated from the *E. coli* cell paste in a soluble fraction and can be purified through, e.g., a protein A or G column depending on the isotype. Final purification can be carried out similar to the process for purifying antibody expressed e.g., in CHO cells.

In addition to prokaryotes, eukaryotic microbes such as filamentous fungi or yeast are suitable cloning or expression hosts for antibody-encoding vectors. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe*; *Kluyveromyces* hosts such as, e.g., *K. lactis*, *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906), *K. thermotolerans*, and *K. marxianus*; *yarrowia* (EP 402,226); *Pichia pastoris* (EP 183,070); *Candida*; *Trichoderma reesia* (EP 244,234); *Neurospora crassa*; *Schwanniomyces* such as *Schwanniomyces occidentalis*; and filamentous fungi such as, e.g., *Neurospora*, *Penicillium*, *Tolypocladium*, and *Aspergillus* hosts such as *A. nidulans* and *A. niger*. For a review discussing the use of yeasts and filamentous fungi for the production of therapeutic proteins, see, e.g., Gerngross, *Nat. Biotech.* 22:1409-1414 (2004).

Certain fungi and yeast strains may be selected in which glycosylation pathways have been "humanized," resulting in the production of an antibody with a partially or fully human glycosylation pattern. See, e.g., Li et al., *Nat. Biotech.* 24:210-215 (2006) (describing humanization of the glycosylation pathway in *Pichia pastoris*); and Gerngross et al., supra.

Suitable host cells for the expression of glycosylated antibody are also derived from multicellular organisms (invertebrates and vertebrates). Examples of invertebrate cells include plant and insect cells. Numerous baculoviral strains and variants and corresponding permissive insect host cells from hosts such as *Spodoptera frupperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the invention, particularly for transfection of *Spodoptera frupperda* cells.

Plant cell cultures of cotton, corn, potato, soybean, *petunia*, tomato, duckweed (Leninaceae), alfalfa (*M. truncatula*), and tobacco can also be utilized as hosts. See, e.g., U.S. Pat. Nos. 5,959,177, 6,040,498, 6,420,548, 7,125,978, and 6,417,429 (describing PLANTIBODIES™ technology for producing antibodies in transgenic plants).

Vertebrate cells may be used as hosts, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 cells or HEK-293 cells, including cells subcloned for growth in suspension culture, Graham et al., *J. Gen Virol.* 36:59 (1977), or other variants including FREESTYLE™ 293-F cells (Invitrogen, Carlsbad, Calif.)); baby hamster kidney cells (BHK, ATCC CCL 10); mouse sertoli cells (TM4, Mather, *Biol. Reprod.* 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., *Annals N.Y. Acad. Sci.* 383:44-68 (1982)); MRC 5 cells; FS4 cells; and a human hepatoma line (Hep G2).

Other useful mammalian host cell lines include Chinese hamster ovary (CHO) cells, including DHFR⁻ CHO cells (Urlaub et al., *Proc. Natl. Acad. Sci. USA* 77:4216 (1980)); and myeloma cell lines such as NS0 and Sp2/0. For a review of certain mammalian host cell lines suitable for antibody production, see, e.g., Yazaki and Wu, *Methods in Molecular Biology*, Vol. 248 (B. K. C. Lo, ed., Humana Press, Totowa, N.J., 2003), pp. 255-268.

Host cells are transformed with the above-described expression or cloning vectors for antibody production and cultured in conventional nutrient media modified as appropriate for inducing promoters, selecting transformants, or amplifying the genes encoding the desired sequences.

9. Culturing the Host Cells

The host cells used to produce a self-crosslinking antibody may be cultured in a variety of media. Commercially available media such as Ham's F10 (Sigma), Minimal Essential Medium ((MEM), (Sigma), RPMI-1640 (Sigma), and Dulbecco's Modified Eagle's Medium ((DMEM), Sigma) are suitable for culturing the host cells. In addition, any of the media described in Ham et al., *Meth. Enz.* 58:44 (1979), Barnes et al., *Anal. Biochem.* 102:255 (1980), U.S. Pat. Nos. 4,767,704; 4,657,866; 4,927,762; 4,560,655; or 5,122,469; WO 90/03430; WO 87/00195; or U.S. Pat. Re. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as GENTAMYCIN™ drug), trace elements (defined as inorganic compounds usually present at final concentrations in the micro-molar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

B. Purification of Antibody

When using recombinant techniques, the antibody can be produced intracellularly, in the periplasmic space, or directly secreted into the medium. If the antibody is produced intracellularly, as a first step, the particulate debris, either host cells or lysed fragments, are removed, for example, by centrifugation or ultrafiltration. Carter et al., *Bio/Technology* 10:163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody composition prepared from the cells can be purified using, for example, hydroxylapatite chromatography, hydrophobic interaction chromatography, gel electrophoresis, dialysis, and affinity chromatography, with affinity chromatography being among one of the typically preferred purification steps. The suitability of protein A as an affinity ligand depends on the species and isotype of any immunoglobulin Fc domain that is present in the antibody. Protein A can be used to purify antibodies that are based on human γ1, γ2, or γ4 heavy chains (Lindmark et al., *J. Immunol. Meth.* 62:1-13 (1983)). Protein G is recommended for all mouse isotypes and for human γ3 (Guss et al., *EMBO J.* 5:15671575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the antibody comprises a $C_H3$ domain, the Bakerbond ABX™ resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the antibody to be recovered.

In general, various methodologies for preparing antibodies for use in research, testing, and clinical are well-established in the art, consistent with the above-described methodologies and/or as deemed appropriate by one skilled in the art for a particular antibody of interest.

C. Compositions Comprising Self-Crosslinking Antibody-Agent Conjugates

In certain embodiments, the self-crosslinking antibodies are conjugated to one or more therapeutic or diagnostic agent, e.g., imaging agents, therapeutically effective agents or compounds in therapeutically effective amounts or both. Provided are such complexes, in some embodiments comprising a plurality of meditopes, one or more linkers, and one or more agents.

The current disclosure contemplates conjugating a therapeutic or diagnostic (e.g. imaging) agent or compound to a meditope or variant thereof, a linker, and/or an antibody to treat, prevent, diagnose or monitor a disease or condition. In one aspect, such conjugation of a self-crosslinking antibody to an agent provides a highly versatile platform technology that will significantly improve mAb based therapeutics and imaging methods to treat and detect disease.

Agents can be conjugated by any means known in the art. In some embodiments, the agent is conjugated to a lysine, tyrosine, glutamic acid, aspartic acid, formylglycine or aldehyde tag, an unnatural amino acid, etc. A formylglycine or aldehyde tag can comprise a 6-amino acid (LCTPSR; SEQ ID NO: 247) or 13-amino acid (LCTPSRGSLFTGR, SEQ ID NO: 248) sequence that can be recognized and targeted by formylglycine-generating enzyme (FGE) to generate a reactive aldehyde group. The reactive aldehyde group can be useful in subsequence reactions comprising conjugating meditopes to agents. See Carrico et al., Nature Chemical Biology 3, 321-322 (2007).

The diagnostic and therapeutic agents include any such agent, which are well-known in the relevant art. Among the imaging agents are fluorescent and luminescent substances, including, but not limited to, a variety of organic or inorganic small molecules commonly referred to as "dyes," "labels," or "indicators." Examples include fluorescein, rhodamine, acridine dyes, Alexa dyes, and cyanine dyes. Enzymes that may be used as imaging agents in accordance with the embodiments of the disclosure include, but are not limited to, horseradish peroxidase, alkaline phosphatase, acid phosphatase, glucose oxidase, β-galactosidase, β-glucoronidase or β-lactamase. Such enzymes may be used in combination with a chromogen, a fluorogenic compound or a luminogenic compound to generate a detectable signal.

Radioactive substances that may be used as imaging agents in accordance with the embodiments of the disclosure include, but are not limited to $^{18}$F, $^{32}$P, $^{33}$P, $^{45}$Ti, $^{47}$Sc, $^{52}$Fe, $^{59}$Fe, $^{62}$Cu, $^{64}$Cu, $^{67}$Cu, $^{67}$Ga, $^{67}$Ga, $^{77}$As, $^{86}$Y, $^{90}$Y. $^{89}$Sr, $^{94}$Zr, $^{94}$Tc, $^{94}$Tc, 99mTc, $^{99}$Mo, $^{105}$Pd, $^{105}$Rh, $^{111}$Ag, $^{111}$In, $^{123}$I, $^{124}$I, $^{125}$I, $^{131}$I, $^{142}$Pr, $^{143}$Pr, $^{149}$Pm, $^{153}$Sm, $^{154-158}$Gd, $^{161}$Tb, $^{166}$Dy, $^{166}$Ho, $^{169}$Er, $^{175}$Lu, $^{177}$Lu, $^{186}$Re, $^{189}$Re, $^{194}$Ir, $^{198}$Au, $^{199}$Au, $^{211}$At, $^{211}$Pb, $^{212}$Bi, $^{212}$Pb, $^{213}$Bi, $^{223}$Ra and $^{225}$Ac. Paramagnetic ions that may be used as additional imaging agents in accordance with the embodiments of the disclosure include, but are not limited to, ions of transition and lanthanide metals (e.g. metals having atomic numbers of 21-29, 42, 43, 44, or 57-71). These metals include ions of Cr, V, Mn, Fe, Co, Ni, Cu, La, Ce, Pr, Nd, Pm, Sm, Eu, Gd, Tb, Dy, Ho, Er, Tm, Yb and Lu.

When the imaging agent is a radioactive metal or paramagnetic ion, the agent may be reacted with another long-tailed reagent having a long tail with one or more chelating groups attached to the long tail for binding to these ions. The long tail may be a polymer such as a polylysine, polysaccharide, or other derivatized or derivatizable chain having pendant groups to which the metals or ions may be added for binding. Examples of chelating groups that may be used according to the disclosure include, but are not limited to, ethylenediaminetetraacetic acid (EDTA), di ethylenetriaminepentaacetic acid (DTPA), DOTA, NOTA, NETA, TETA, porphyrins, polyamines, crown ethers, bis-thiosemicarbazones, polyoximes, and like groups. The chelate is normally linked to the PSMA antibody or functional antibody fragment by a group, which enables the formation of a bond to the molecule with minimal loss of immunoreactivity and minimal aggregation and/or internal cross-linking. The same chelates, when complexed with non-radioactive metals, such as manganese, iron and gadolinium are useful for MRI, when used along with the antibodies and carriers described herein. Macrocyclic chelates such as NOTA, DOTA, and TETA are of use with a variety of metals and radiometals including, but not limited to, radionuclides of gallium, yttrium and copper, respectively. Other ring-type chelates such as macrocyclic polyethers, which are of interest for stably binding nuclides, such as $^{223}$Ra for RAIT may be used. In certain embodiments, chelating moieties may be used to attach a PET imaging agent, such as an Al-$^{18}$F complex, to a targeting molecule for use in PET analysis.

Exemplary therapeutic agents include, but are not limited to, drugs, chemotherapeutic agents, therapeutic antibodies and antibody fragments, toxins, radioisotopes, enzymes (e.g., enzymes to cleave prodrugs to a cytotoxic agent at the site of the tumor), nucleases, hormones, immunomodulators, antisense oligonucleotides, RNAi molecules (e.g., siRNA or shRNA), chelators, boron compounds, photoactive agents and dyes. The therapeutic agent may also include a metal, metal alloy, intermetallic or core-shell nanoparticle bound to a chelator that acts as a radiosensitizer to render the targeted cells more sensitive to radiation therapy as compared to healthy cells. Further, the therapeutic agent may include paramagnetic nanoparticles for MRI contrast agents (e.g., magnetite or $Fe_3O_4$) and may be used with other types of therapies (e.g., photodynamic and hyperthermal therapies and imaging (e.g., fluorescent imaging (Au and CdSe)).

Chemotherapeutic agents are often cytotoxic or cytostatic in nature and may include alkylating agents, antimetabolites, anti-tumor antibiotics, topoisomerase inhibitors, mitotic inhibitors hormone therapy, targeted therapeutics and immunotherapeutics. In some embodiments the chemotherapeutic agents that may be used as therapeutic agents in accordance with the embodiments of the disclosure include, but are not limited to, 13-cis-retinoic acid, 2-chlorodeoxyadenosine, 5-azacitidine, 5-fluorouracil, 6-mercaptopurine, 6-thioguanine, actinomycin-D, adriamycin, aldesleukin, alemtuzumab, alitretinoin, all-transretinoic acid, alpha interferon, altretamine, amethopterin, amifostine, anagrelide, anastrozole, arabinosylcytosine, arsenic trioxide, amsacrine, aminocamptothecin, aminoglutethimide, asparaginase, auristatin, dimethylvaline-valine-dolaisoleuine-dolaproine-phenylalanine-p-phenylenediamine (AFP), dovaline-valine-dolaisoleuine-dolaproine-phenylalanine (MMAF), monomethyl auristatin E (MMAE), auromycins, azacytidine, bacillus calmette-guerin (BCG), bendamustine, bevacizumab, etanercept, bexarotene, bicalutamide, bismuth, bortezomib, bleomycin, busulfan, calcium leucovorin, citrovorum factor, capecitabine, canertinib, carboplatin, carmustine, cetuximab, chlorambucil, cisplatin, cladribine, cortisone, cyclophosphamide, cytarabine, cc1065, darbepoetin alfa, dasatinib, daunomycin, decitabine, denileukin diftitox, dexamethasone, dexasone, dexrazoxane, dactinomycin, daunorubicin, decarbazine, docetaxel, dolostatins, doxorubicin, doxifluridine, eniluracil, epirubicin, epoetin alfa, erlotinib, everolimus, exemestane, estramustine, ethidium bromide, etoposide, filgrastim, fluoxymesterone, fulvestrant, flavopiridol, floxuridine, fludarabine, fluorouracil, flutamide, gefitinib, gemcitabine, gemtuzumab, lintuzumab, ozogamicin, goserelin, granulocyte-colony stimulating factor, granulocyte macrophage-colony stimulating factor, hexamethylmelamine, hydrocortisone hydroxyurea, ibritumomab, interferon alpha, interleukin-2, interleukin-11, isotretinoin, ixabepilone, idarubicin, imatinib mesylate, ifosfamide, irinotecan, lapatinib, lenalidomide, letrozole, leucovorin, leuprolide, liposomal Ara-C, lomustine, mechlorethamine, megestrol, melphalan, mercaptopurine, mesna, methotrexate, methylprednisolone, mitomycin C, mitotane, mitoxantrone, maytonsinoids, nelarabine, nilutamide, octreotide, oprelvekin, oxaliplatin, paclitaxel, pamidronate, pemetrexed, panitumumab, PEG Interferon, pegaspargase, pegfilgrastim, PEG-L-asparaginase, pentostatin, plicamycin, prednisolone, prednisone, procarbazine, raloxifene, ricin, ricin A-chain, rituximab, romiplostim, ralitrexed, sapacitabine, sargramostim, satraplatin, sorafenib, sunitinib, semustine, streptozocin, taxol, tamoxifen, tegafur, tegafururacil, temsirolimus, temozolamide, teniposide, thalidomide, thioguanine, thiotepa, topotecan, toremifene, tositumomab, trastuzumab, tretinoin, trimitrexate, alrubicin, vincristine, vinblastine, vindestine, vinorelbine, vorinostat, yttrieum, or zoledronic acid.

Therapeutic antibodies and functional fragments thereof, that may be used as therapeutic agents in accordance with the embodiments of the disclosure include, but are not limited to, alemtuzumab, bevacizumab, cetuximab, edrecolomab, gemtuzumab, lintuzumab, ibritumomab tiuxetan, panitumumab, rituximab, tositumomab, and trastuzumab and other antibodies associated with specific diseases listed herein.

Toxins that may be used as therapeutic agents in accordance with the embodiments of the disclosure include, but are not limited to, ricin, abrin, ribonuclease (RNase), DNase I, Staphylococcal enterotoxin-A, pokeweed antiviral protein, gelonin, diphtheria toxin, *Pseudomonas* exotoxin, and *Pseudomonas* endotoxin.

Radioisotopes that may be used as therapeutic agents in accordance with the embodiments of the disclosure include, but are not limited to, $^{32}$P, $^{89}$Sr, $^{90}$Y, $^{99m}$Tc, $^{99}$Mo, $^{131}$I, $^{153}$Sm, $^{177}$Lu, $^{186}$Re, $^{213}$Bi, $^{223}$Ra and $^{225}$AC.

D. Compositions Comprising Self-Crosslinking Antibodies and Free Meditope

Also provided herein are compositions comprising self-crosslinking antibodies and free meditopes. As described herein, such compositions may be advantageous in modulating or controlling self-crosslinking during expression, formulation, and storage, or for use with any of the methods described herein. Free meditope can be co-expressed with self-crosslinking antibody, as described above, or added to the composition separately.

In some embodiments, the composition comprises a high concentration of free meditope compared to the self-crosslinking antibody. For example, in some embodiments the ratio of self-crosslinking antibody to free meditope is between 1:1 and 1:1,000, including about 1:2, 1:3, 1:4, 1:5, 1:6, 1:7, 1:8, 1:10, 1:15, 1:20, 1:25, 1:50, 1:75, 1:100, 1:150, 1:200, 1:250, 1:300, 1:400, 1:500, and 1:750.

In some embodiments, the composition comprises free meditope with a higher affinity for the meditope binding site of the self-crosslinking antibody than the meditope attached to the self-crosslinking antibody via a linker. In some embodiments, the composition comprises free meditope with a lower affinity for the meditope binding site of the self-crosslinking antibody than the meditope attached to the self-crosslinking antibody via a linker. In some embodiments, the meditope binding site of the self-crosslinking antibody comprises one or more substitutions that alter the binding affinity for one or more meditopes, as described above. For example, the meditope binding site might exhibit a greater affinity for a free meditope than the meditope fused to the self-crosslinking antibody, or vice versa.

Various combinations of concentrations and affinities are also contemplated. Compositions comprising low concentrations of self-crosslinking antibodies and high concentrations of free meditope, wherein the free meditope has a high affinity for the self-crosslinking antibody's meditope binding site, can be advantageous in some embodiments. For example, such embodiments may minimize self-crosslinking during production or storage of self-crosslinking antibodies, or may allow for the production, storage, and use of self-crosslinking antibodies with higher self-crosslinking capacities. In some embodiments, the composition comprises high concentrations of self-crosslinking antibodies and high concentrations of free meditope with a high affinity for the self-crosslinking antibody's meditope binding site. As an exemplary advantage, such embodiments may allow for more concentrated compositions of self-crosslinking antibodies.

As previously described, in some embodiments the formulation has a pH in which the free meditope has an increased affinity for the meditope binding site of a first self-crosslinking or meditope enabled antibody. In some embodiments, the increased affinity of the free meditope at the selected pH is higher than the affinity of the meditope of a second self-crosslinking antibody for the meditope binding site of the first self-crosslinking or meditope enabled antibody. In some embodiments, such differences in affinity can be advantageous in preventing or reducing the self-crosslinking activity of antibody.

Additionally, in some embodiments the meditope of a self-crosslinking antibody exhibits a higher affinity than the free meditope for a meditope binding site at a pH present at the site of the cognate antigen. In some embodiments, the site of the cognate antigen is a targeted cell or tissue, including a cell or tissue with a disease or disorder, including cancer.

E. Characterization of Self-Crosslinking Antibodies

Binding properties of the meditopes to meditope-enabled antibodies can be characterized by any of a number of known methods, including SPR and ITC, for example, to ensure that conjugation to the self-crosslinking antibody does not affect the meditope-Ig interaction. In some cases, such measurements can be limited in their ability to synergistic effects, given that these approaches generally do not involve antigen present on a cell surface (such as on the surface of a tumor cell). Thus, in some aspects, FACS analysis and/or cell viability assays are used to quantify the effect of the self-crosslinking antibody directly on cells expressing antigen recognized by the antibody (e.g., cells that overexpress EGFR in the context of cetuximab). In general, a cell line expressing (e.g., over-expressing) the antigen recognized by the self-crosslinking antibody is incubated with the self-crosslinking antibody under conditions whereby the antibody binds to the antigen expressed on the cells. In some cases, varying concentrations of the antibody are used. Appropriate incubation times and washes are carried out. A non-self-crosslinking meditope-enabled antibody coupled to multivalent or monovalent meditopes may be used as positive and negative controls, respectively. The antibodies and meditopes may be labeled with agents detectable by flow cytometry or microscopy, which are well known. In some examples, a shift (in the case of FACS) or increased signal in the presence of a self-crosslinking antibody, for example compared to a non-self-crosslinking antibody, indicates a synergistic or additive effect. In another example, to further confirm the additive effects of the self-crosslinking antibody, a non-labeled, monovalent meditope is used in a competition assay, to determine whether it can compete with the labeled self-crosslinking antibody for binding to other antigen-bound self-crosslinking antibody.

In other examples, cell viability assays are used to determine the ability of a self-crosslinking antibody to enhance cell-killing effects. For example, a cell expressing the antigen of interest may be incubated with varying concentrations of the self-crosslinking antibody. Multivalent meditopes and monovalent meditopes bound to non-self-crosslinking meditope enabled antibodies again are useful as controls. In some examples, MTT (3-(4,5-Dimethylthiazol-2-yl)-2,5-diphenyltetrazolium bromide), is used to quantify the number or percentage of viable cells. Other approaches for measuring cell viability, proliferation, and/or death are known in the art and may be used.

In another example, for self-crosslinking antibodies that demonstrate activity in such assays, Western blot analysis or other biochemical or signaling approach is performed to investigate inhibition of signaling associated with a particular antigen, such as a cell surface receptor (e.g., in the case of cetuximab, to follow the phosphorylation status of EGFR, AKT, MAP which are part of the EGFR signaling pathway). Data from such studies may be compared with data from cells treated only with meditope-enabled antibody (i.e., without meditope), with monovalent meditopes, with multivalent meditopes, and/or with tyrosine kinase or other known inhibitors (AG1478, etc.). In some examples, an increase in cell death as a function of self-crosslinking antibody concentration is observed, demonstrating synergistic cell killing effects of the self-crosslinking antibody.

F. Selecting Biologically Active Antibodies

Antibodies produced as described above may be subjected to one or more "biological activity" assays to select an antibody with beneficial properties from a therapeutic perspective or selecting formulations and conditions that retain biological activity of the antibody. The antibody may be tested for its ability to bind the antigen against which it was raised. In some embodiments, the binding of the antibody may be determined by saturation binding; ELISA; and/or competition assays (e.g. RIA's), for example. Also, the antibody may be subjected to other biological activity assays, e.g., in order to evaluate its effectiveness as a therapeutic. Such assays are known in the art and depend on the target antigen and intended use for the antibody.

To screen for antibodies which bind to a particular epitope on the antigen of interest, a routine cross-blocking assay such as that described in *Antibodies, A Laboratory Manual*, Cold Spring Harbor Laboratory, Ed Harlow and David Lane (1988), can be performed. Alternatively, epitope mapping, e.g. as described in Champe et al., *J. Biol. Chem.* 270:1388-1394 (1995), can be performed to determine whether the antibody binds an epitope of interest.

G. Preparation of the Formulations

After preparation of the antibody of interest (e.g., techniques for producing antibodies which can be formulated as disclosed herein will be elaborated below and are known in the art), the pharmaceutical formulation comprising it is prepared. In certain embodiments, the antibody to be formulated has not been subjected to prior lyophilization and the formulation of interest herein is an aqueous formulation. In certain embodiments, the antibody is a full length antibody. In one embodiment, the antibody in the formulation is an antibody fragment, such as an F(ab')$_2$, in which case problems that may not occur for the full length antibody (such as clipping of the antibody to Fab) may need to be addressed. The therapeutically effective amount of antibody present in the formulation is determined by taking into account the desired dose volumes and mode(s) of administration, for example. From about 25 mg/mL to about 150 mg/mL, or from about 30 mg/mL to about 140 mg/mL, or from about 35 mg/mL to about 130 mg/mL, or from about 40 mg/mL to about 120 mg/mL, or from about 50 mg/mL to about 130 mg/mL, or from about 50 mg/mL to about 125 mg/mL, or from about 50 mg/mL to about 120 mg/mL, or from about 50 mg/mL to about 110 mg/mL, or from about 50 mg/mL to about 100 mg/mL, or from about 50 mg/mL to about 90 mg/mL, or from about 50 mg/mL to about 80 mg/mL, or from about 54 mg/mL to about 66 mg/mL is an exemplary antibody concentration in the formulation.

In some embodiments, the formulation further comprises free meditope. The free meditope can reduce or prevent self-crosslinking antibodies from self-crosslinking during production, isolation, and/or storage. Such free meditope can be expressed and isolated along with the self-crosslinking antibodies, as described above, or produced and added to compositions and formulations separately. Some embodiments contain an excess of free-meditope peptide. In some embodiments, the amount of free meditope can be stoichiometrically related to the amount of self-crosslinking antibody. For example, in some embodiments, the ratio of self-crosslinking antibody to free meditope is between 1:1 and 1:1,000, including about 1:2, 1:3, 1:4, 1:5, 1:6, 1:7, 1:8, 1:10, 1:15, 1:20, 1:25, 1:50, 1:75, 1:100, 1:150, 1:200, 1:250, 1:300, 1:400, 1:500, and 1:750. In some embodiments, the free amount of meditope peptide is determined by concentration, including, for example from about 0.1 mg/mL to about 150 mg/mL.

An aqueous formulation is prepared comprising the antibody in a pH-buffered solution. The buffer of this invention has a pH in the range from about 5.0 to about 7.0. In certain embodiments the pH is in the range from about 5.0 to about 6.5, the pH is in the range from about 5.0 to about 6.4, in the range from about 5.0 to about 6.3, the pH is in the range from about 5.0 to about 6.2, the pH is in the range from about 5.0 to about 6.1, the pH is in the range from about 5.5 to about 6.1, the pH is in the range from about 5.0 to about 6.0, the pH is in the range from about 5.0 to about 5.9, the pH is in the range from about 5.0 to about 5.8, the pH is in the range from about 5.1 to about 6.0, the pH is in the range from about 5.2 to about 6.0, the pH is in the range from about 5.3 to about 6.0, the pH is in the range from about 5.4 to about 6.0, the pH is in the range from about 5.5 to about 6.0, the pH is in the range from about 5.6 to about 6.0, the pH is in the range from about 5.7 to about 6.0, or the pH is in the range from about 5.8 to about 6.0. In certain embodiments of the invention, the formulation has a pH of 6.0 or about 6.0. In certain embodiments of the invention, the formulation has a pH of 5.9 or about 5.9. In certain embodiments of the invention, the formulation has a pH of 5.8 or about 5.8. In certain embodiments of the invention, the formulation has a pH of 5.7 or about 5.7. In certain embodiments of the invention, the formulation has a pH of 5.6 or about 5.6. In certain embodiments of the invention, the formulation has a pH of 5.5 or about 5.5. In certain embodiments of the invention, the formulation has a pH of 5.4 or about 5.4. In certain embodiments of the invention, the formulation has a pH of 5.3 or about 5.3. In certain embodiments of the invention, the formulation has a pH of 5.2 or about 5.2.

Examples of buffers that will control the pH within this range include histidine (such as L-histidine) or sodium acetate. In certain embodiments, the buffer contains histidine acetate or sodium acetate in the concentration of about 15 mM to about 25 mM. In certain embodiments of the invention, the buffer contains histidine acetate or sodium acetate in the concentration of about 15 mM to about 25 mM, about 16 mM to about 25 mM, about 17 mM to about 25 mM, about 18 mM to about 25 mM, about 19 mM to about 25 mM, about 20 mM to about 25 mM, about 21 mM to about 25 mM, about 22 mM to about 25 mM, about 15 mM, about 16 mM, about 17 mM, about 18 mM, about 19 mM, about 20 mM, about 21 mM, about 22 mM, about 23 mM, about 24 mM, or about 25 mM. In one embodiment, the buffer is histidine acetate or sodium acetate in an amount of about 20 mM, pH 5.0. In one embodiment, the buffer is histidine acetate or sodium acetate in an amount of about 20 mM, pH 5.1. In one embodiment, the buffer is histidine acetate or sodium acetate in an amount of about 20 mM, pH 5.2. In one embodiment, the buffer is histidine acetate or sodium acetate in an amount of about 20 mM, pH 5.3. In one embodiment, the buffer is histidine acetate or sodium acetate in an amount of about 20 mM, pH 5.4. In one embodiment, the buffer is histidine acetate or sodium acetate in an amount of about 20 mM, pH 5.5. In one embodiment, the buffer is histidine acetate or sodium acetate in an amount of about 20 mM, pH 5.6. In one embodiment, the buffer is histidine acetate or sodium acetate in an amount of about 20 mM, pH 5.7. In one embodiment, the buffer is histidine acetate or sodium acetate in an amount of about 20 mM, pH 5.8. In one embodiment, the buffer is histidine acetate or sodium acetate in an amount of about 20 mM, pH 5.9. In one embodiment, the buffer is histidine acetate or sodium acetate in an amount of about 20 mM, pH 6.0. In one embodiment, the buffer is histidine acetate or sodium acetate in an amount of about 20 mM, pH 6.1. In one embodiment, the buffer is histidine acetate or sodium acetate in an amount of about 20 mM, pH 6.2. In one embodiment, the buffer is histidine acetate or sodium acetate in an amount of about 20 mM, pH 6.3. In one embodiment, the buffer is histidine acetate or sodium acetate in an amount of about 25 mM, pH 5.2. In one embodiment, the buffer is histidine acetate or sodium acetate in an amount of about 25 mM, pH 5.3. In one embodiment, the buffer is histidine acetate or sodium acetate in an amount of about 25 mM, pH 5.4. In one embodiment, the buffer is histidine acetate or sodium acetate in an amount of about 25 mM, pH 5.5. In one embodiment, the buffer is histidine acetate or sodium acetate in an amount of about 25 mM, pH 5.6. In one embodiment, the buffer is histidine acetate or sodium acetate in an amount of about 25 mM, pH 5.7. In one embodiment, the buffer is histidine acetate or sodium acetate in an amount of about 25 mM, pH 5.8. In one embodiment, the buffer is histidine acetate or sodium acetate in an amount of about 25 mM, pH 5.9. In one embodiment, the buffer is histidine acetate or sodium acetate in an amount of about 25 mM, pH 6.0. In one embodiment, the buffer is histidine acetate or sodium acetate in an amount of about 25 mM, pH 6.1. In one embodiment, the buffer is histidine acetate or sodium acetate in an amount of about 25 mM, pH 6.2. In one embodiment, the buffer is histidine acetate or sodium acetate in an amount of about 25 mM, pH 6.3.

The formulation can further comprise sucrose in an amount of about 60 mM to about 240 mM. In some embodiments, sucrose in the formulation is about 60 mM to about 230 mM, about 60 mM to about 220 mM, about 60 mM to about 210 mM, about 60 mM to about 200 mM, about 60 mM to about 190 mM, about 60 mM to about 180 mM, about 60 mM to about 170 mM, about 60 mM to about 160 mM, about 60 mM to about 150 mM, about 60 mM to about 140 mM, about 80 mM to about 240 mM, about 90 mM to about 240 mM, about 100 mM to about 240 mM, about 110 mM to about 240 mM, about 120 mM to about 240 mM, about 130 mM to about 240 mM, about 140 mM to about 240 mM, about 150 mM to about 240 mM, about 160 mM to about 240 mM, about 170 mM to about 240 mM, about 180 mM to about 240 mM, about 190 mM to about 240 mM, about 200 mM to about 240 mM, about 80 mM to about 160 mM, about 100 mM to about 140 mM, or about 110 mM to about 130 mM. In some embodiments, sucrose in the formulation is about 60 mM, about 70 mM, about 80 mM, about 90 mM, about 100 mM, about 110 mM, about 120 mM, about 130 mM, about 140 mM, about 150 mM, about 160 mM, about 170 mM, about 180 mM, about 190 mM, about 200 mM, about 210 mM, about 220 mM, about 230 mM, or about 240 mM.

In some embodiments, the antibody concentration in the formulation is about 40 mg/ml to about 125 mg/ml. In some embodiments, the antibody concentration in the formulation is about 40 mg/ml to about 120 mg/ml, about 40 mg/ml to about 110 mg/ml, about 40 mg/ml to about 100 mg/ml, about 40 mg/ml to about 90 mg/ml, about 40 mg/ml to about 80 mg/ml, about 40 mg/ml to about 70 mg/ml, about 50 mg/ml to about 120 mg/ml, about 60 mg/ml to about 120 mg/ml, about 70 mg/ml to about 120 mg/ml, about 80 mg/ml to about 120 mg/ml, about 90 mg/ml to about 120 mg/ml, or about 100 mg/ml to about 120 mg/ml. In some embodiments, the antibody concentration in the formulation is about 60 mg/ml. In some embodiments, the antibody concentration in the formulation is about 65 mg/ml. In some embodiments, the antibody concentration in the formulation is about 70 mg/ml. In some embodiments, the antibody concentration in the formulation is about 75 mg/ml. In some embodiments, the antibody concentration in the formulation is about 80 mg/ml. In some embodiments, the antibody concentration in the formulation is about 85 mg/ml. In some embodiments, the antibody concentration in the formulation is about 90 mg/ml. In some embodiments, the antibody concentration in the formulation is about 95 mg/ml. In some embodiments, the antibody concentration in the formulation is about 100 mg/ml. In some embodiments, the antibody concentration in the formulation is about 110 mg/ml. In some embodiments, the antibody concentration in the formulation is about 125 mg/ml.

In some embodiments, a surfactant is added to the antibody formulation. Exemplary surfactants include nonionic surfactants such as polysorbates (e.g. polysorbates 20, 80 etc.) or poloxamers (e.g. poloxamer 188, etc.). The amount of surfactant added is such that it reduces aggregation of the formulated antibody and/or minimizes the formation of particulates in the formulation and/or reduces adsorption. For example, the surfactant may be present in the formulation in an amount from about 0.001% to about 0.5% (w/v). In some embodiments, the surfactant (e.g., polysorbate 20) is from about 0.005% to about 0.2%, from about 0.005% to about 0.1%, from about 0.005% to about 0.09%, from about 0.005% to about 0.08%, from about 0.005% to about 0.07%, from about 0.005% to about 0.06%, from about 0.005% to about 0.05%, from about 0.005% to about 0.04%, from about 0.008% to about 0.06%, from about 0.01% to about 0.06%, from about 0.02% to about 0.06%, from about 0.01% to about 0.05%, or from about 0.02% to about 0.04%. In certain embodiments, the surfactant (e.g., polysorbate 20) is present in the formulation in an amount of 0.005% or about 0.005%. In certain embodiments, the surfactant (e.g., polysorbate 20) is present in the formulation in an amount of 0.006% or about 0.006%. In certain embodiments, the surfactant (e.g., polysorbate 20) is present in the formulation in an amount of 0.007% or about 0.007%. In certain embodiments, the surfactant (e.g., polysorbate 20) is present in the formulation in an amount of 0.008% or about 0.008%. In certain embodiments, the surfactant (e.g., polysorbate 20) is present in the formulation in an amount of 0.009% or about 0.009%. In certain embodiments, the surfactant (e.g., polysorbate 20) is present in the formulation in an amount of 0.01% or about 0.01%. In certain embodiments, the surfactant (e.g., polysorbate 20) is present in the formulation in an amount of 0.02% or about 0.02%. In certain embodiments, the surfactant (e.g., polysorbate 20) is present in the formulation in an amount of 0.03% or about 0.03%. In certain embodiments, the surfactant (e.g., polysorbate 20) is present in the formulation in an amount of 0.04% or about 0.04%. In certain embodiments, the surfactant (e.g., polysorbate 20) is present in the formulation in an amount of 0.05% or about 0.05%. In certain embodiments, the surfactant (e.g., polysorbate 20) is present in the formulation in an amount of 0.06% or about 0.06%. In certain embodiments, the surfactant (e.g., polysorbate 20) is present in the formulation in an amount of 0.07% or about 0.07%. In certain embodiments, the surfactant (e.g., polysorbate 20) is present in the formulation in an amount of 0.08% or about 0.08%. In certain embodiments, the surfactant (e.g., polysorbate 20) is present in the formulation in an amount of 0.1% or about 0.1%. In certain embodiments, the surfactant (e.g., polysorbate 20) is present in the formulation in an amount of 0.2% or about 0.2%. In certain embodiments, the surfactant (e.g., polysorbate 20) is present in the formulation in an amount of 0.3% or about 0.3%. In certain embodiments, the surfactant (e.g., polysorbate 20) is present in the formulation in an amount of 0.4% or about 0.4%. In certain embodiments, the surfactant (e.g., polysorbate 20) is present in the formulation in an amount of 0.5% or about 0.5%.

In one embodiment, the formulation contains the above-identified agents (e.g., antibody, buffer, sucrose, and/or surfactant) and is essentially free of one or more preservatives, such as benzyl alcohol, phenol, m-cresol, chlorobutanol and benzethonium Cl. In another embodiment, a preservative may be included in the formulation, particularly where the formulation is a multi-dose formulation. The concentration of preservative may be in the range from about 0.1% to about 2%, preferably from about 0.5% to about 1%. One or more other pharmaceutically acceptable carriers, excipients or stabilizers such as those described in Remington's Pharmaceutical Sciences 16th edition, Osol, A. Ed. (1980) may be included in the formulation provided that they do not adversely affect the desired characteristics of the formulation. Acceptable carriers, excipients or stabilizers are nontoxic to recipients at the dosages and concentrations employed and include; additional buffering agents; co-solvents; anti-oxidants including ascorbic acid and methionine; chelating agents such as EDTA; metal complexes (e.g. Zn-protein complexes); biodegradable polymers such as polyesters; and/or salt-forming counterions. Exemplary pharmaceutically acceptable carriers herein further include interstitial drug dispersion agents such as soluble neutral-active hyaluronidase glycoproteins (sHASEGP), for example, human soluble PH-20 hyaluronidase glycoproteins, such as rHuPH20 (HYLENEX®, Baxter International, Inc.). Certain exemplary sHASEGPs and methods of use, including rHuPH20, are described in US Patent Publication Nos. 2005/0260186 and 2006/0104968. In one aspect, a sHASEGP is combined with one or more additional glycosaminoglycanases such as chondroitinases.

The formulation herein may also contain more than one protein as necessary for the particular indication being treated, preferably those with complementary activities that do not adversely affect the other protein. For example, a self-crosslinking antibody may be combined with one or more additional agents (e.g., a chemotherapeutic agent, anti-neoplastic agent, or imaging agent).

In some embodiments, the physical stability, chemical stability, or biological activity of the antibody in the formulation is evaluated or measured. Any methods known in the art and described in the Examples herein may be used to evaluate the stability and biological activity of the antibody in the formulation. For example, stability of the antibody in the formulation can be measured by, but not limited to, size exclusion chromatography (SEC or SE-HPLC), imaged capillary isoelectric focusing (ICIEF), peptide mapping, small-volume light obscuration (HIAC) assay, and capillary electrophoresis (CE) techniques such as CE-sodium dodecyl sulfate (CE-SDS) and CE-glycan analysis. In some embodiments, the antibody in the formulation is stable at −20° C. for at least about 6 months, at least about 8 months, at least about 10 months, at least about 12 months, at least about 14 months, at least about 16 months, at least about 18 months, at least about 20 months, at least about 21 months, at least about 22 months, at least about 23 months, at least about 24 months, at least about 3 years, or at least about 4 years. In some embodiments, the antibody in the formulation is stable at 2° C. to 8° C. (e.g., 5° C.) for at least about 6 months, at least about 8 months, at least about 10 months, at least about 12 months, at least about 14 months, at least about 16 months, at least about 18 months, at least about 20 months, at least about 21 months, at least about 22 months, at least about 23 months, or at least about 24 months. In some embodiments, the stability of the antibody (i.e., an antibody monomer) is measured by size exclusion chromatography in the formulation after storage. In some embodiments, the stability of the antibody is (i.e., an antibody monomer) measured by imaged capillary isoelectric focusing in the formulation after storage. In some embodiments, the percent of antibody monomer in the formulation as compared to total protein (e.g., including antibody and aggregates) is greater than about 60%, about 65%, about 70%, about 75%, about 80%, about 85%, about 86%, about 87%, about 88%, about 89%, about 90%, about 91%, about 92%, about 93%, about 94% or about 95% after storage at −20° C. for at least about 6 months, at least about 12 months, at least about 18 months, or at least about 24 months. In some embodiments, the percent of antibody monomer in the formulation as compared to (e.g., including antibody and aggregates) is greater than about 60%, about 65%, about 70%, about 75%, about 80%, about 85%, about 86%, about 87%, about 88%, about 89%, about 90%, about 91%, about 92%, about 93%, about 94% or about 95% after storage at 2° C. to 8° C. (e.g., 5° C.) for at least about 6 months, at least about 12 months, at least about 18 months, or at least about 24 months. In some embodiments, the percent of antibody monomer in the formulation as compared to (e.g., including antibody and aggregates) is greater than about 60%, about 65%, about 70%, about 75%, about 80%, about 85%, about 86%, about 87%, about 88%, about 89%, about 90%, about 91%, about 92%, about 93%, about 94% or about 95% after agitation at room temperature (e.g., about 15° C. to 25° C.) for at least about 2 hours, at least about 4 hours, at least about 6 hours, at least about 8 hours, at least about 10 hours, at least about 12 hours, at least about 14 hours, at least about 16 hours, at least about 18 hours, at least about 20 hours, or at least about 24 hours. In some embodiments, the percent of total aggregates (e.g., high molecular weight species and low molecular weight species) in the formulation is less than any of about 0.1%, about 0.2%, about 0.3%, about 0.4%, about 0.5%, about 0.6%, about 0.7%, about 0.8%, about 0.9%, about 1%, about 2%, about 3%, about 4%, about 5%, about 6%, about 7%, about 8%, about 9%, or about 10% after storage at −20° C. for at least about 6 months, at least about 12 months, at least about 18 months, or at least about 24 months. In some embodiments, the percent of total aggregates (e.g., high molecular weight species and low molecular weight species) in the formulation is less than any of about 0.1%, about 0.2%, about 0.3%, about 0.4%, about 0.5%, about 0.6%, about 0.7%, about 0.8%, about 0.9%, about 1%, about 2%, about 3%, about 4%, about 5%, about 6%, about 7%, about 8%, about 9%, or about 10% after storage at 2° C. to 8° C. (e.g., 5° C.) for at least about 6 months, at least about 12 months, at least about 18 months, or at least about 24 months. In some embodiments, the percent of total aggregates (e.g., high molecular weight species and low molecular weight species) in the formulation is less than any of about 0.1%, about 0.2%, about 0.3%, about 0.4%, about 0.5%, about 0.6%, about 0.7%, about 0.8%, about 0.9%, about 1%, about 2%, about 3%, about 4%, about 5%, about 6%, about 7%, about 8%, about 9%, or about 10% after agitation at room temperature (e.g., about 15° C. to 25° C.) for at least about 2 hours, at least about 4 hours, at least about 6 hours, at least about 8 hours, at least about 10 hours, at least about 12 hours, at least about 14 hours, at least about 16 hours, at least about 18 hours, at least about 20 hours, or at least about 24 hours. In any of the embodiments herein, the stable formulation can be stored in a glass vial, a metal alloy container, or an intravenous (IV) bag. In some embodiments, the metal alloy is 316L stainless steel or hastelloy.

The formulations to be used for in vivo administration should be sterile. This is readily accomplished by filtration through sterile filtration membranes, prior to, or following, preparation of the formulation.

III. METHODS OF USE

Also provided herein are methods and uses of the self-crosslinking antibodies. Among the provided methods are methods of delivering self-crosslinking antibodies and antigen binding fragments thereof, optionally comprising agents conjugated thereto, to cells and tissues expressing antigens recognized by the self-crosslinking antibodies. In some embodiments, the self-crosslinking antibodies crosslink meditope-enabled antibodies, including meditope-enabled self-crosslinking antibodies. In some embodiments, the antibodies target cell surface antigens. Exemplary antigens include antigens expressed by a disease or condition of a cell or tissue thereof, or cell surface receptors capable of receptor mediated endocytosis.

A. Methods for Altering the Distribution of a Cell Surface Antigen

Provided are methods for using self-crosslinking antibodies, including meditope enabled self-crosslinking antibodies, to target cell surface antigens and produce changes in the distribution of those antigens on the surface of host cells. For example, the display of cell surface antigens, such as tumor associated antigens, receptors such as GPCRs, receptor tyrosine kinase, other signaling molecules such as CTLA4, and other epitopes present on cell surface proteins, can be manipulated and/or reorganized through the use of self-crosslinking antibodies that recognize epitopes on those antigens. Reorganization of the receptors and signaling molecules can have a profound effect on signaling pathways and cellular responses.

In vivo, this type of reorganization occurs through cell-cell contact, where ligands from one cell engage receptors on the other cell, effectively creating a multivalent interaction. Through this point of contact, the receptor/ligands are localized or brought into proximity to one another, creating a signaling "synapse". The signaling synapse initiates post-translational modifications within the cell, and can, for example, alter actin and microtubule organization or protein phosphorylation, ultimately leading to specific transcriptional events.

Self-crosslinking antibodies can be used in a similar fashion to alter the distribution of cell surface antigens. In some embodiments, the methods enhance or increase co-localization, aggregation, or clustering of cell-surface antigens on target cells. In some aspects, the increase is an increase in degree, speed, and/or duration in comparison to that observed prior to or in the absence of the addition of the self-crosslinking antibody, or in the presence of the antibody without the meditope crosslinker. Specifically, one or more self-crosslinking antibodies can be administered and permitted to bind to a targeted antigen on the surface of a cell in conjunction. This effect is illustrated by the use of two self-crosslinking meditope-enabled antibodies. This combination allows for one meditope fused via a linker to the Fab arm of a first meditope-enabled antibody to engage with a Fab arm of a second meditope enabled antibody. The binding permits the formation of a complex of linked antibodies bound to their cognate antigens. In this scenario, one would expect a "linear" arrangement of the two self-crosslinking meditope-enabled antibodies bound to cell surface antigens. In some aspects, the meditope is able to "latch-on" to adjacent antibodies, e.g., IgGs, to form a "daisy-chain"-like or web-like array of self-linking antibodies bound to cell surface antigens. The antibodies associate with each other, drawing or crosslinking the surface antigens towards one another, effectively altering the display of those antigens on the surface of the cell. Thus, the use of larger numbers of self-crosslinking antibodies can be used, for example, in antibodies targeting tumor antigens, given the high antigen density of tumor cells.

In some embodiments, each arm of the self-crosslinking antibody or antigen binding fragment thereof comprises a meditope bound to the antibody or fragment thereof. As previously described, the linkers can be attached to one or both heavy chains, one or both light chains, or a combination of one or more heavy and light chains in some embodiments. Thus, in some embodiments, each meditope on the self crosslinking antibody can independently bind to a meditope binding site on one or more antibodies. For example, in some embodiments, the self-crosslinking antibody can bind to a meditope binding site on each arm of another meditope enabled antibody. In some embodiments, this alters or increases the binding affinity of a self-crosslinking antibody to the other antibody. As another example, in some embodiments, each meditope of the self-crosslinking antibody can bind to a meditope binding site on a different antibody. Such binding can increase the number of interconnected self-crosslinking antibodies, which can further alter binding geometry, surface antigen distribution, or antibody-antigen complexes.

In a different embodiment, the self-crosslinking antibodies can be used mark a specific cell for an immune response. In this case, clustering of receptors associated with self-crosslinking antibodies would present a "high" concentration of Fc domain for the FcR on T cells. Multiple investigations have demonstrated that the Fc domain can be specifically tuned through a limited number of point mutations to elicit the appropriate response.

Provided are methods for delivering antibodies for enhancing or increasing internalization and/or degradation of cell-surface antigens on target cells. In some embodiments, the methods are carried out by administering to the cells one or more self-crosslinking antibodies that specifically bind to the cell surface antigen(s) and comprise a meditope coupled to the antibody via a linker. In some embodiments, internalization and/or degradation of the antigen is promoted, enhanced or increased. In some aspects, the increase in internalization is an increase in degree, speed, and/or duration in comparison to that observed prior to or in the absence of the addition of the self-crosslinking antibody, or in the presence of the antibody without the meditope. In some embodiments, the methods alter internalization or intracellular trafficking. In some embodiments, the methods alter intercellular or intracellular signaling.

An alternative approach for promoting or altering internalization rates is by promoting or controlling the aggregation of cell bound receptors, as in certain embodiments provided herein. In some embodiments herein, co-localization, clustering, aggregation, internalization, and/or intracellular trafficking or sorting is effected, recapitulated, or enhanced or altered using self-crosslinking antibodies. Observed herein are differences in clustering and/or internalization of such surface receptors following administration to cells of self-crosslinking antibodies recognizing such receptor antigens in comparison to administration of non-self-crosslinking antibodies, including antibodies that do not comprise meditopes fused via linkers. Among the provided embodiments are self-crosslinking antibodies that promote co-localization and clustering of surface antigens recognized by the meditope enabled antibodies, and/or internalization/trafficking/sorting of such antigens, including cell-surface antigens, including receptors. Cell surface proteins on a host cell forced to internalize would be less available for interaction with their cognate ligands, which could impact the ability of the host cell to respond to that ligand.

Studies have demonstrated that the size of a particle localized to the cell membrane is important for some mechanisms of internalization (see *Biochem J.* 2004 Jan. 1; 377(Pt 1):159-69; *J Nanobiotechnology.* 2014 Feb. 3; 12:5. doi: 10.1186/1477-3155-12-5), suggesting the size of an associated ligand may affect some internalization pathways. The use of self-crosslinking antibodies would create the appearance of a ligand with a larger particle size as compared to a single antibody bound to a cell surface antigen. In some embodiments, the larger particle size can enhance antigen or cell surface receptor internalization.

In another embodiment, the efficacy of antibody treatments can be altered and improved i) by manipulating the binding affinity of the meditope coupled to an antibody for the meditope binding site of a meditope enabled antibody, ii) by selecting a meditope enabled antibody with a preferred binding affinity for its cognate epitope on a target antigen, or iii) by manipulating both features to optimize the lifetime as well as the specificity of targeting of the self-crosslinking meditope enabled antibody complex. Specifically, the lifetime of an interaction is related to the kinetic off-rate. In some instances, it can be envisioned that the longest possible lifetime would be advantageous. In other cases, a moderate lifetime (tau=10 ms to 10 minutes) would be advantageous. In the latter case, there are specific receptors (e.g., EGFR or Her2) that are overexpressed on tumor tissues, but also expressed on certain healthy tissues, albeit at a lower level (10, 100 or 1000 fold). Clinically, it may be desirable to bind to the tumor and not bind to the healthy tissue. Using a combination of self-crosslinking antibodies with a moderate life-time enhances the selectivity. Specifically, at low concentrations of antigen as found in a normal cell, a meditope enabled antibody could bind to the antigen. However, the likelihood of a second meditope enabled antibody engaged to antigen is low, preventing antibody crosslinking. In states with high concentrations of antigen, including some disease states, the likelihood of an adjacent meditope enabled antibody engaged antigen is higher, allowing bridging between two or more self-crosslinking antibody-associated antigens.

As previously described, in some embodiments, the methods provide an increased degree and/or speed of internalization of a cell-surface antigen. Increased or more rapid internalization can be advantageous when an antibody is delivered to promote downregulation of a surface receptor or other surface antigen associated with or causative in the progression of disease. It can also be advantageous, for example, by reducing the amount of a receptor or other surface antigen on a cell's surface, for example, by targeting it for degradation. Some such receptors, including co-receptors, are capable of effecting or mediating cell signaling.

Therefore, the methods described herein can reduce, interfere with, or eliminate harmful cell signaling pathways in some embodiments. In some embodiments, the compositions and methods described herein can increase antigen internalization by 1.5-, 2-, 3-, 4-, 5-, 6-, 7-, 8-, 9-, 10-, 20-, 30-, 40-, 50-, 75-, 100-, 200-, 300-, 400-, 500-fold or more. In some embodiments, the compositions and methods described herein can reduce the amount of antigen present on a cell's surface by 1.5-, 2-, 3-, 4-, 5-, 6-, 7-, 8-, 9-, 10-, 20-, 30-, 40-, 50-, 75-, 100-, 200-, 300-, 400-, 500-fold or more. In some embodiments, the compositions and methods described herein can increase antibody internalization by 1.5-, 2-, 3-, 4-, 5-, 6-, 7-, 8-, 9-, 10-, 20-, 30-, 40-, 50-, 75-, 100-, 200-, 300-, 400-, 500-fold or more, including the internalization of antibodies with low internalization rates.

A slower degree or less rapid internalization may be desirable in some contexts, such as those in which the antibody is delivered to promote effector functions such as ADCC and/or complement-mediated lysis, and/or to engage and promote signaling via the cell-surface receptor antigens. In some embodiments, the method promotes or enhances the degree of a signal via the cell surface antigen and/or an effector function mediated via the bound antibody.

In some embodiments, a non-internalizing antigen is one in which the binding of a monospecific bivalent antibody without a meditope bound via a linker results in no internalization of the antigen, a degree of internalization that is no more than that resulting from metabolic turnover or in the absence of an antibody specific for the antigen, or that is not greater than 2-fold greater than that resulting from metabolic turnover or in the absence of an antigen-specific antibody. In some embodiments, the antigen following incubation with a monospecific bivalent antibody without a meditope bound via a linker does not internalize at a rate that is 3-, 4-, 5-, 6-, 7-, 8-, or 9-fold greater than that resulting from metabolic turnover or in the absence of an antigen-specific antibody.

In some embodiments, the non-internalizing antigen is one in which the binding of a natural binding partner or ligand for the cell-surface antigen alone results in no internalization of the antigen, or a degree of internalization that is no more than that resulting from metabolic turnover or in the absence of the binding partner or ligand, or that is not greater than 2-fold greater than that resulting from metabolic turnover or in the absence of ligand/binding partner. In some embodiments, the antigen following incubation of cells with a natural ligand or binding partner for the antigen does not internalize at a rate that is 3-, 4-, 5-, 6-, 7-, 8-, or 9-fold greater than that resulting from metabolic turnover or in the absence of the ligand or binding partner. In some embodiments, the antigen is internalized following binding of a monospecific bivalent antibody without a meditope bound via a linker or natural ligand or binding partner at a half-time that is at least 10, 11, 12, 13, 14, 15, or 16 hours or more.

B. Methods for Increasing the Efficacy of an Antibody Therapy

Also provided are methods for delivering antibodies to cells, including antibodies comprising agents coupled thereto. In some embodiments, the methods are carried out by administering to the cells one or more self-crosslinking antibodies that specifically bind to the cell surface antigen(s) and comprise a meditope coupled to the antibody via a linker.

In some embodiments, the methods increase antibody internalization by a cell. Increased or more rapid internalization can be advantageous, for example, in the context of ADC or other uses in which the antibody is used to deliver an agent to a cell or in which the antibody is delivered to promote downregulation of a surface receptor or other surface antigen associated with or causative in the progression of disease, such as cancer, for example, by targeting it for degradation.

In other embodiments, the provided methods utilize properties of cells and alter the internalization and sorting pathway of conjugated biologics to efficiently release an agent associated with the self-crosslinking antibody. As previously discussed, studies have demonstrated that the size of a particle localized to the cell membrane is important for some mechanisms of internalization, suggesting the size of an associated ligand may affect some internalization pathways. The use of self-crosslinking antibodies would create the appearance of a ligand with a larger particle size as compared to a single antibody bound to a cell surface antigen.

Also provided are methods and uses of such self-crosslinking antibodies in delivering meditopes, including free meditopes, including multivalent meditopes and meditopes fused to other proteins or protein domains. Some meditopes can be coupled to agents, for example, in therapeutic and imaging methods. Exemplary methods are those effecting delivery of an agent, such as a therapeutic or imaging agent, coupled to a meditope, including a multivalent meditope, optionally including meditopes not fused to an antibody via a linker.

Some potentially useful antibodies that recognize specific antigens abundant on the surface of target cells are "poorly internalizable" (Matzku et al. *Int. J. Cancer.* 1988 2:11-14; Reilly et al. *Clin. Pharmacokinet.* 1995 28:126-142). Poor or suboptimal internalization diminishes intracellular delivery and accumulation in target organs or tissues (Matzku et al. *Int. J. Cancer.* 1988 2:11-14; Reilly et al. *Clin. Pharmacokinet.* 1995 28:126-142). Therefore, these "poorly internalizable" antibodies are not optimized for intracellular targeting. Accordingly, there is a need for antibody systems that enhance antibody targeting and internalization by cells.

Some antibodies exert a therapeutic effect after entering a cell. In some embodiments, increased or more rapid internalization can increase an antibody's potency or efficacy. Therefore, in some embodiments, lower dosages can be used to achieve the same therapeutic effect. In some embodiments, administration of a self-crosslinking antibody can achieve the same therapeutic effect as administration of antibody alone using 1.5-, 2-, 3-, 4-, 5-, 6-, 7-, 8-, 9-, 10-, 20-, 30-, 40-, 50-, 75-, 100-, 200-, 300-, 400-, or 500-fold less drug.

In some embodiments, increased or more rapid internalization results in increased or more rapid delivery of an antibody to endosomes. Some antibodies comprise linkers comprising a proteolytic cleavage site. The linkers can be conjugated to agents, including imaging or therapeutic agents, which are then released by the antibody upon internalization. In some embodiments, linker cleavage occurs in endosomes or lysosomes. Therefore, increased or more rapid delivery of an antibody to endosomes or lysosomes can increase an antibody's potency or efficacy.

In some embodiments, the meditope, the linker, or the antibody is coupled to a therapeutic or diagnostic agent, such as a chemotherapeutic, cytotoxin, or radiolabeled agent, such as for use in ADC or radioimmunotherapy (RIT). In some embodiments, the methods described herein are useful to enhance delivery of an agent or other methods for antibody-mediated delivery to a cell or tissue expressing an antigen targeted by the antibody. In some embodiments, the methods are advantageous in that they promote clustering and therefore internalization of antigens, antibodies bound to the antigens, and agents associated with the antibodies, in the context of non-internalizing antigens, such as carcinoembryonic antigen (CEA), tumor-associated glycoprotein (TAG-72), KS1/4 (see Schmidt et al., *Cancer Immunol Immunother.* December 2008; 57(12): 1879-1890; Myer et al. *Cancer Res* 1993; 53:3956-3963).

Similarly, with antibodies conjugated to various agents, such as imaging agents, the ability to cluster or co-localize cell and/or internalize surface antigens can be important. For example, drug-conjugated biologics such as antibody-drug conjugates (ADCs) are generally designed with a goal of selectively delivering an agent, e.g., an active drug, within the targeted tissue, often within a cell of the targeted tissue or targeted cell, such as a tumor cell. The targeting biologic, e.g., the antibody, is generally designed to preferentially bind to the cell of interest; selective binding to antigens present only on the target cells or tissues and/or present at very low amounts or infrequently on other tissues, can be especially desirable. Particularly for drug-conjugated antibodies directly targeting diseased cells, e.g., tumor cells, it can be desirable or important that the agent-conjugated antibody is internalized within the target cell following binding to the target antigen on the cell surface. See, e.g., Trail et al., *Antibodies* 2013, 2, 113-129; H. L. Perez, et al., *Drug Discov Today* (2013). In some contexts, antibodies that result in internalization of antigens are also desirable in the context of radioimmunotherapy (RIT). See Boudousq V et al., *PLoS ONE* 8(7): e69613 (2013). In general, the conjugated agent, e.g., drug, is released and is active within the target cell. In some contexts, for example in targeting of certain extracellular matrix components and/or antigens specific to the tumor environment, internalization may not be necessary. See Ackerman et al., *Cancer Immunol Immunother.* July 2008; 57(7): 1017-1027.

In some embodiments, the provided methods utilize properties of tumor cells and alter the internalization and sorting pathway of conjugated biologics to efficiently release the agent. In some embodiments, the methods effect co-localization, clustering, aggregation, internalization, and/or intracellular trafficking or sorting of the antigen and/or meditope-enabled antibodies, and/or recapitulation or enhancement or alteration thereof. Observed herein are differences in clustering and/or internalization of self-crosslinking antibodies compared to non-self-crosslinking antibodies following administration to cells.

Despite the successful development of TDM1, an anti-Her2 ADC that is marketed as KADCYLA®, only a small fraction of the conjugated drug (~2%) is delivered to the tumor. The precise reason for such a low delivery yield is not clear, however, it likely stems from the different internalization routes utilized by the cell (e.g., clathrin-mediated endocytosis and/or caveolae-mediated endocytosis and/or macropinocytosis) as well as routing of the endocytosed material once inside the cell (recycling endosomes or late endosomes or lysosomes). Drugs conjugated to the antibody through a disulfide linker may be released due to the reducing environment of the cellular cytoplasm. Alternatively, some drug conjugates, such as auristatin, may be released by specific proteases active in endosomal vesicles. Other studies using different linkers indicate that the lysosome is an effective means in releasing the drug, independent of conjugation chemistry. Yet disulfides can be reduced in serum and proteases can be active in healthy tissue. In some embodiments, the provided methods, antibodies (including self-crosslinking antibodies), and meditopes provide improvements such as more specific and effective delivery of agents, such as toxins to treat disease.

In tumor immunotherapy, many antigens are merely tumor-associated or expressed at higher levels on tumor cells/environments, as opposed to being tumor-specific. For example, while Her2 and EGFR are significantly overexpressed in tumor tissues such as Her2+ breast cancer and colorectal cancers, they are also expressed in healthy tissues, which can result in on-target, off-tissue toxicities. Other types of antigens (such as tumor-specific antigens and oncofetal antigens, e.g., carcinoembryonic antigen (CEA)) are expressed solely in tumor tissues and/or otherwise minimally or at only certain stages of development. Combinations of monoclonal antibodies (mAbs) that recognize unique epitopes on the same antigen can produce synergistic effects, including enhancement of various antibody effector functions (e.g., ADCC, complement-dependent lysis, signaling inhibition), enhancement of cell death, and in the case of cancer-targeting antibodies, enhancement of tumor growth inhibition. See, for example, Dechant M et al., "Complement-dependent tumor cell lysis triggered by combinations of epidermal growth factor receptor antibodies," *Cancer Res,* 2008 Jul. 1; 68(13):4998-5003; Scheuer W et al., "Strongly enhanced antitumor activity of trastuzumab and pertuzumab combination treatment on HER2-positive human xenograft tumor models," *Cancer Res,* 2009 Dec. 15; 69(24):9330-6; Cardarelli P M et al., "Binding to CD20 by anti-B1 antibody or F(ab')(2) is sufficient for induction of apoptosis in B-cell lines," *Cancer Immunol Immunother,* 2002 March; 51(1):15-24. Epub 2001 Dec. 18.

In some aspects, the self-crosslinking antibody is used instead of a bispecific antibody, e.g., to achieve synergy in combination with a meditope-enabled antibody. In some aspects, the self-crosslinking antibody provides advantages compared to use of a bispecific antibody recognizing two separate epitopes on the same antigen. For example, production of the self-crosslinking antibody can be more efficient and cost-effective when compared to manufacturing a bispecific antibody. In some aspects, the self-crosslinking antibodies also are comparatively more easily targeted to disease sites, such as tumors. Given the nature of the meditope binding site (within the meditope binding site, separate from the antibody CDRs), and the broadly applicable methods provided herein for meditope-enabling any antibody of choice, the self-crosslinking antibody and meditope enabled antibody also have the advantage of being readily applicable to a large range of therapeutic antibodies, without the need to generate a bispecific antibody with therapeutically acceptable characteristics, and the associated and significant cost of its development.

In some embodiments, the compounds and methods are useful in deriving synergistic tumor inhibition (Kamat, V., et al., *Cancer Biol Ther* 7, 726-733 (2008); Koefoed K, et al. (2011) MAbs 3(6):584-595; Spangler J B, et al. (2010) *Proc Natl Acad Sci USA* 107(30):13252-13257), as observed in the trastuzumab-pertuzumab combination (Baselga J, et al. (2012). *N Engl J Med* 366(2):109-119). In some examples, self-crosslinking antibodies function as second "mAb"-like molecules, but with the flexibility of being able to pair up with any compatible meditope enabled antibody. In some aspects, this reduces the cost of identifying and developing a second therapeutic mAb. In some embodiments, multivalent meditope variants (e.g., generated by altering valency and/or linker geometry) further enhance specificity and synergistic effects.

Similarly, in some embodiments, two self-crosslinking meditope-enabled antibodies, each of which specifically binds to a different antigen expressed on the surface of the same cell, are used in place of a bivalent antibody. In some embodiments, the methods provide enhanced antigen (e.g., receptor) aggregation, and/or a certain level aggregation regardless of the ratio of the density or presence of the two antigens relative to one another on the cell surface. In some aspects, the methods enhance cell-surface clustering of antigens and/or co-localization. In one embodiment, two or more self-crosslinking antibodies are used to achieve such clustering together with recognizing multiple different antigens. Thus, in some embodiments, as compared to a bispecific antibody, in which clustering would occur only where each arm of the antibody bound its respective antigen, clustering in such an embodiment may be achieved even where the antigen bound by one of the antibodies is present at a much higher density on the cell surface compared to the antigen bound by another. Furthermore, in some embodiments, the use of two self-crosslinking antibodies can also enhance efficacy where the distance between two cell surface antigens exceeds the distance between the two arms of a bispecific antibody. In such embodiments, the linker length can be varied to accommodate the actual or expected distances between cell surface antigens, as described above.

In some embodiments, the self-crosslinking antibodies provide advantages over and/or improvements in bivalent antibodies. In some embodiments, the self-crosslinking antibody is a bispecific meditope-enabled antibody, e.g., to enhance aggregation of two antigens, e.g., cell-surface antigens, bound by the different arms of the bispecific antibody, for example, to enhance affinity, signaling induced by the antibody, effector functions, and/or internalization, as compared to use of the bispecific antibody alone. Thus, in some aspects, the self-crosslinking bispecific meditope-enabled antibody provides an increased level of efficacy, for example, by causing an additional degree of clustering as compared to the bispecific antibody alone.

Antibodies and binding compounds (e.g., meditopes) provided have practical utility and in some embodiments can overcome hurdles associated with available mAb-based technologies. In some embodiments, the provided compounds and methods address the problem of antigenicity that can arise with non-native reagents, which for example, expose new surfaces, which can be antigenic, and/or concerns with stability and the scalability in the manufacturing of such molecules (Nelson A L (2010) Antibody fragments: hope and hype. MAbs 2(1):77-83). Cetuximab is used successfully in the clinic and is stable and produced at scale. In some embodiments, the unique combination of residues that line the meditope binding site is distant in sequence (i.e., unlikely to be a peptide T-cell epitope) and located within a deep cavity (i.e., unlikely to be a surface exposed B-cell epitope)). Thus, in some embodiments, mAbs containing the meditope binding site are not immunogenic.

In some embodiments, the meditope binding site is used as a specific point of conjugation, useful in avoiding issues of heterogeneity and conjugation efficiency that typically affect the development of effective ADCs by available methods. A toxin-bearing meditope in some embodiments can direct a reactive chemical to the Fab cavity, favoring specificity and unit stoichiometry.

In some aspects, moderate affinity of meditopes (e.g., cQFD and cQYN meditopes) is advantageous, such as when considering a multivalent approach ((Mammen M, Choi S, & Whitesides G (1998) Polyvalent interactions in biological systems: Implications for design and use of multivalent ligands and inhibitor. *Angew. Chem., Int. Ed. Eng* 37:2755)), in some embodiments, different un-natural amino acids, cyclization strategies, and/or screening methods are used to improve affinity and/or pharmacokinetics/pharmacodynamics/toxicity. As demonstrated herein, in some embodiments, it is equally possible to tailor the meditope binding site to accommodate changes in the meditope.

C. Therapeutic and Diagnostic Uses and Pharmaceutical Compositions

In one embodiment, the self-crosslinking antibody is used to deliver therapeutic agents, diagnostic agents (e.g., imaging agents), or a combination thereof for treatment, diagnosis (e.g., imaging) a disease or condition. A self-crosslinking antibody-drug conjugate may be used in a method for directing treatment to a particular type of cell or population of cells in a disease or condition that can be targeted by a therapeutic antibody. Such a method of treatment may include administering a therapeutically effective amount of a pharmaceutical composition to a subject having the disease or condition via any suitable route of administration. The pharmaceutical composition may include a self-crosslinking antibody or functional fragment thereof.

In some embodiments, the provided self-crosslinking antibodies and complexes thereof are used in treatment, diagnosis or imaging of a disease or condition, including any cancer, disease or other condition that may be treated or targeted using a therapeutic antibody. Cancers avoid immune surveillance by actively suppressing the immune system. One method envisioned for counteracting this immunosuppression is through vaccination using epitopes of antigens that are either uniquely expressed or over-expressed by the tumor cells. For example, self-crosslinking antibodies that block signaling pathways, sequester growth factor and/or induce an immune response have been successfully implemented in the clinic to treat cancer and other diseases.

Thus, the diseases and conditions include any cancer, as well as other diseases and conditions, including those targeted using therapeutic monoclonal antibodies (mAbs), including, but not limited to, leukemia and lymphomas (which can be treated or imaged using, e.g., self-crosslinking versions of alemtuzumab, bectumomab, gemtuzumab, lintuzumab, FBTA05, ibritumomab tiuzetan, ofatumumab, rituximab, tositumomab), breast cancer (which can be treated or imaged using, e.g., self-crosslinking versions of trastuzumab, adecatumumab, ertumaxomab) prostate cancer (which can be treated or imaged using, e.g., self-crosslinking versions of adecatumumab, capromab pendetide, etaracizumab), colorectal cancer (which can be treated or imaged using, e.g., self-crosslinking versions of labetuzumab, panitumumab, altumumab pentetate, votumumab), gastrointestinal cancers (which can be treated or imaged using, e.g., self-crosslinking versions of arcitumumab, catumaxomab), ovarian cancer (which can be treated or imaged using, e.g., self-crosslinking versions of abagovomab, catumaxomab, etaracizumab, igovomab, oregovomab), lung cancer (which can be treated or imaged using, e.g., self-crosslinking versions of anatumumab mafenatox), pancreatic cancer (which can be treated or imaged using, e.g., self-crosslinking versions of clivatuzumab tetraxetan), renal cancer (which can be treated or imaged using, e.g., self-crosslinking versions of girentuximab), melanoma cancer (which can be treated or imaged using, e.g., self-crosslinking versions of etaracizumab, ipilimumab, TRBS07), glioma (which can be treated or imaged using, e.g., self-crosslinking versions of nimotuzumab), bone metastases (which can be treated or imaged using, e.g., self-crosslinking versions of denosumab), head and neck cancer (which can be treated or imaged using, e.g., self-crosslinking versions of zalutumumab), cardiovascular disease (which can be treated or imaged using, e.g., self-crosslinking versions of abciximab), autoimmune disorders (which can be treated or imaged using, e.g., self-crosslinking versions of adalimumab, infliximab), rheumatoid arthritis (which can be treated or imaged using, e.g., self-crosslinking versions of atlizumab, golimumab, infliximab), transplant rejection (which can be treated or imaged using, e.g., self-crosslinking versions of basiliximab, daclizumab, muromonab-CD3), Crohn's disease (which can be treated or imaged using, e.g., self-crosslinking versions of certolizumab, fontolizumab, natalizumab, infliximab, visilizumab), hemoglobinuria (which can be treated or imaged using, self-crosslinking versions of eculizumab), psoriasis (which can be treated or imaged using, e.g., self-crosslinking versions of efalizumab, infliximab, ustekinumab), multiple sclerosis (which can be treated or imaged using, e.g., self-crosslinking versions of natalizumab, ustekinumab), asthma (which can be treated or imaged using, e.g., self-crosslinking versions of benralizumab, mepolizumab, omalizumab), respiratory syncytial virus (RSV) (which can be treated or imaged using, e.g., self-crosslinking versions of palivizumab), macular degeneration (which can be treated or imaged using, e.g., self-crosslinking versions of ranibizumab), appendicitis (which can be treated or imaged using, e.g., self-crosslinking versions of fanolesomab) and any other condition that may be targeted or treated with an antibody. The above-listed antibodies and related diseases or disorders are examples only and do not limit the platform.

In certain embodiments, the meditope-enabled self-crosslinking antibody can be bound by one or more free meditopes, meditope variants, multivalent meditope tethering agents or multivalent meditope variant tethering agents. Such meditopes may be conjugated to one or more imaging agents, therapeutically effective agents or compounds in therapeutically effective amounts or both. Administration of meditope-enabled self-crosslinking antibody bound by meditopes or variants thereof with the therapeutically effective compound may treat, prevent, diagnose or monitor a disease or condition. Such conjugation of a high affinity and/or multivalent meditope coupled to meditope-enabled mAbs provides a highly versatile platform technology that will significantly improve mAb based therapeutics and imaging methods to treat and detect disease.

In some embodiments, the provided methods and compounds are useful in antibody engineering, antibody-drug conjugates (ADCs), antibody-directed enzyme prodrug therapies (ADEPT), immune system engagement (e.g., Fc modifications (Desjarlais J R & Lazar G A (2011) Modulation of antibody effector function. Exp Cell Res 317(9): 1278-1285), chemokine fusion, bi-specific T-cell engagers (Wolf E, Hofmeister R, Kufer P, Schlereth B, & Baeuerle P A (2005) BiTEs: bispecific antibody constructs with unique anti-tumor activity. *Drug Discov Today* 10(18):1237-1244) and disease imaging (e.g., immunoPET and pre-targeted radionuclide imaging (Goldenberg D M, et al. (2012) Pretargeted molecular imaging and radioimmunotherapy. Theranostics 2(5):523-540; Pagel J M, et al. (2006) Comparison of a tetravalent single-chain antibody-streptavidin fusion protein and an antibody-streptavidin chemical conjugate for pre-targeted anti-CD20 radioimmunotherapy of B-cell lymphomas. Blood 108(1):328-336).

In some aspects, the provided methods and compounds overcome issues observed in available such methods, for example, those using post-translational chemical modifications or manipulation of the gene sequence, which can for example lead to undesirable consequences that are detrimental to therapeutic and imaging applications. For example, with ADCs targeting cytotoxins to disease sites using available methods, chemical conjugation of the toxin (typically involves lysines, reduced cysteines, or sugars on the mAb) can produce a heterogeneous mixture, which can adversely affect the specificity and stability of the mAb and alter its bio-distribution.

In other embodiments, a method for imaging tumors or other tissues is provided. In such methods, a self-crosslinking antibody that is labeled with an imaging agent is administered via any suitable route of administration and will bind to the therapeutic antibodies that are bound to the target tumor or tissue. Examples of imaging agents include but are not limited to radiolabels (e.g., $^{3}H$, $^{14}C$, $^{35}S$, $^{90}Y$, $^{99m}TC$, $^{125}I$, $^{131}I$, $^{177}Lu$, $^{166}Ho$, and $^{153}Sm$), metal or magnetic labels (e.g., gold, iron, gadolinium), biotin, chelating agents (e.g., 1,4,7,10-tetraazacyclododecane-N,N', N",N"'-tetraacetic acid ("DOTA")) or any agent described above. In one embodiment, the imaging agent used with the method described herein is DOTA.

As another example, reducing the size of the mAb to Fab fragments (e.g., single chain Fab variable domain (scFvs)) to facilitate tumor penetration and enhance imaging using available methods can reduce the valency and thus affect both the affinity and the tissue specificity compared to the original mAb. In other cases, with available methods, as part of a pre-targeted imaging protocol to enhance detection, mAbs conjugated with streptavidin or multiple Fabs/scFvs stitched together through a scaffold (e.g., "lock-and-dock") can be immunogenic, unstable in serum, and technically difficult and expensive to produce, especially at scales necessary for clinical use. The provided compounds and methods in some embodiments are useful in overcoming such difficulties, for example, by providing an alternative mAb platform and improved mAb-based delivery systems for cancer and other diseases and conditions.

D. Modulating the Effects of Self-Crosslinking Antibodies

Also provided are methods for altering the effects of a self-crosslinking antibody with a free meditope. In some embodiments, the free meditope can compete with a meditope fused to self-crosslinking antibodies for binding to meditope binding sites. Generally, the methods comprise contacting a meditope binding site of a meditope enabled antibody with a free meditope. Binding between the meditope binding site and free meditope can occupy the meditope binding site, thereby inhibiting, reducing, or preventing a meditope from a self-crosslinking antibody from contacting or binding to the meditope binding site. In some embodiments, the free meditope can displace or disrupt a meditope fused to a self-crosslinking antibody via a linker. Because the binding between a meditope and a meditope binding site is generally non-covalent, such binding can be temporary or reversible.

In some embodiments, the methods reverse or reduce the effects of a self-crosslinking antibody. Such effects include, for example, reversing or reducing the ability of the self-crosslinking antibody to alter the distribution, co-localization, or internalization of a cell surface antigen. Such effects also include, for example, reversing or reducing the ability of the self-crosslinking antibody to alter or increase the rate of antibody internalization, antibody efficacy, or decrease the dosage of antibody therapy needed to achieve a desired therapeutic effect.

As an exemplary advantage, such methods may allow for the modulation of certain treatments over time. For example, in some embodiments a self-crosslinking antibody with a long half-life is administered, but the effects of the antibody are modulated by the administration of free meditope with a shorter half-life. In some embodiments, the free meditope's shorter half-life allows for the temporary inhibition of antibody self-crosslinking until the free meditope levels drop due to degradation or clearance. When the free meditope levels drop, the peptides are less effective at inhibiting self-crosslinking, and self-crosslinking can resume. Such half-lives can be minutes, hours, days, or weeks long depending on the free meditope's structure and the conditions under which it is used.

These effects can be useful in modulating or minimizing side effects that may be a byproduct of antibody therapy, including self-crosslinking antibody therapy. For example, in some embodiments a free meditope is administered simultaneously with, shortly before, or shortly after the administration of a self-crosslinking antibody. In some embodiments, the methods include using a composition comprising both the self-crosslinking antibody and free meditope, or a first composition comprising the self-crosslinking antibody and a second composition comprising the free meditope. In some embodiments, the free meditope reduces or prevents self-crosslinking, and therefore aggregation, before the antibody binds to its cognate antigen. In some embodiments, this can reduce the amount of self-crosslinking that occurs in the blood, which can reduce the amount of self-crosslinking antibody that may deposit in capillaries. In some embodiments, reducing self-crosslinking and aggregation reduces the amount of antibody cleared by the kidney or liver. Thus, administering self-crosslinking antibody with free meditope, including, for example, a free-meditope peptide with a shorter half-life than the self-crosslinking antibody, can temporarily reduce or delay self-crosslinking. Such a reduction or delay can allow time for the self-crosslinking antibody to bind to its cognate antigen before beginning to self-crosslink with other antibodies, thereby reducing self-crosslinking or aggregation in blood vessels, tissues or organs that are not intended as antibody targets.

In another exemplary method, free meditope can be administered to a subject who has already received self-crosslinking antibody to reverse, reduce, or alter the effects of the self-crosslinking antibody. Such methods may be useful in reducing the therapeutic effects or side effects caused by self-crosslinking antibodies. In some embodiments, it may be useful to temporally control self-crosslinking. As previously described, self-crosslinking antibodies can be used to alter the distribution of an antigen on a cell's surface or increase the rates of antibody or antigen internalization. In some embodiments it may be advantageous to control or reduce these effects by reducing or inhibiting self-crosslinking. Such methods can include the administration of free meditopes.

In some embodiments, the free meditope has a long half-life, thereby permanently or semi-permanently altering self-crosslinking. In some embodiments, a free meditope with a half-life that is shorter than the half-life of the self-crosslinking antibody is administered. In some embodiments, administration of a free meditope with a short half-life causes the temporary reduction or inhibition of self-crosslinking. In some embodiments, the subject receives a plurality of free meditope administrations. Such administrations can be delivered as "booster doses" to prolong or extend the inhibiting or reducing effects of the free meditope. Alternatively, such administrations can be delivered over longer periods of time, thereby allowing the self-crosslinking abilities of the antibody to be inhibited and restored over time. In such an embodiment, high levels of free meditope can inhibit self-crosslinking. As the free meditope is cleared or degrades, less is available to occupy meditope binding sites of self-crosslinking antibodies, thereby restoring antibody self-crosslinking. A subsequent administration of additional free-meditope peptide can once again reduce or inhibit antibody self-crosslinking.

The extent of the inhibition or reduction of self-crosslinking be modulated in some embodiments by administering higher or lower dosages of free meditope. In some embodiments, administering a larger dose of free meditope will have a greater inhibitory effect than a smaller dose. Such dosages can be calculated, for example, as a ratio of free meditope to self-crosslinking antibody, as an amount necessary to produce a therapeutic effect for a desired amount of time, as a relative or absolute IC50, or as an amount calculated by weight or volume.

The extent of the inhibition or reduction of self-crosslinking can be modulated in some embodiments by administering free meditopes with specific affinities for a meditope binding site. For example, in some embodiments, a free meditope with a high affinity has a higher, stronger, or longer effect on inhibiting or reducing self-crosslinking than a free meditope with a lower affinity. In some embodiments, a free meditope with a higher affinity binds to a meditope binding site stronger or with a longer off-rate than a free meditope with a lower affinity. In some embodiments, antibody self-crosslinking can be reduced or inhibited with lower amounts of free meditopes with higher affinities as compared to the amounts of free meditopes with lower affinities needed to achieve the same effect.

In some embodiments, a free meditope with a lower affinity can be used to have a more modest or temporary effect on self-crosslinking. In some embodiments, such meditopes can be used to adjust the efficacy of a particular antibody therapy.

In some embodiments, the free meditope is administered a plurality of times, including, for example, optionally 2, 3, 4, 5, 6, 7, 8, 9, 10 or more times. In some embodiments, the administrations take place over a period of minutes, hours, days, months, or years. In some embodiments, a plurality of free meditopes are administered, which plurality can comprise free meditopes that are the same or different. For example, in some embodiments, a first free meditope can comprise a first affinity for a meditope binding site, and a second free meditope can comprise a second affinity for the meditope binding site. The first and second free meditopes can differ in half-life or IC50. Administering the first and/or second free meditope can allow for additional mechanisms for altering meditope self-crosslinking.

IV. METHODS OF ADMINISTRATION

The formulation is administered to a mammal in need of treatment with the antibody, preferably a human, in accord with known methods, such as intravenous administration (e.g., as a bolus or by continuous infusion over a period of time), by intramuscular, intraperitoneal, intracerobrospinal, subcutaneous, intra-articular, intrasynovial, intrathecal, oral, topical, or inhalation routes. In one embodiment, the formulation is administered to the mammal by intravenous administration. For such purposes, the formulation may be injected using a syringe or via an IV line, for example. In one embodiment, the formulation is administered to the mammal by subcutaneous administration.

The appropriate dosage ("therapeutically effective amount") of the antibody will depend, for example, on the condition to be treated, the severity and course of the condition, whether the antibody is administered for preventive or therapeutic purposes, previous therapy, the patient's clinical history and response to the antibody, the type of antibody used, and the discretion of the attending physician. The antibody is suitably administered to the patient at one time or over a series of treatments and may be administered to the patient at any time from diagnosis onwards. The antibody may be administered as the sole treatment or in conjunction with other drugs or therapies useful in treating the condition in question.

As a general proposition, the therapeutically effective amount of the antibody administered to human will be in the range of about 0.01 to about 50 mg/kg of patient body weight whether by one or more administrations. In some embodiments, the antibody used is about 0.01 to about 45 mg/kg, about 0.01 to about 40 mg/kg, about 0.01 to about 35 mg/kg, about 0.01 to about 30 mg/kg, about 0.01 to about 25 mg/kg, about 0.01 to about 20 mg/kg, about 0.01 to about 15 mg/kg, about 0.01 to about 10 mg/kg, about 0.01 to about 5 mg/kg, or about 0.01 to about 1 mg/kg administered daily, for example. In some embodiments, the antibody is administered at 15 mg/kg. However, other dosage regimens may be useful. In one embodiment, a self-crosslinking antibody described herein is administered to a human at a dose of about 100 mg, about 200 mg, about 300 mg, about 400 mg, about 500 mg, about 600 mg, about 700 mg, about 800 mg, about 900 mg, about 1000 mg, about 1100 mg, about 1200 mg, about 1300 mg or about 1400 mg on day 1 of 21-day cycles. The dose may be administered as a single dose or as multiple doses (e.g., 2 or 3 doses), such as infusions. The dose of the antibody administered in a combination treatment may be reduced as compared to a single treatment. The progress of this therapy is easily monitored by conventional techniques.

In some embodiments, the disease or disorder is cancer. In some embodiments, the cancer is locally advanced or metastatic. In some embodiments, the cancer is selected from the group consisting of a solid tumor, a hematologic cancer, bladder cancer, brain cancer, breast cancer, colon cancer, colorectal cancer, gastric cancer, glioma, head cancer, leukemia, liver cancer, lung cancer (e.g., non-small cell lung cancer), lymphoma, myeloma, neck cancer, ovarian cancer, melanoma, pancreatic cancer, renal cancer, salivary cancer, stomach cancer, thymic epithelial cancer, thyroid cancer, and squamous cell carcinoma of the head and neck.

In some embodiments, the disease or disorder is infection. In some embodiments, the infection is a persistent infection. In some embodiments, the infection is a viral infection, a bacterial infection, a fungal infection, a helminth infection, or a protozoan infection. In some embodiments, the viral infection is selected from the group consisting of cytomegalovirus Epstein-Barr virus, hepatitis B, hepatitis C virus, herpes virus, measles virus, influenza, human immunodeficiency virus, human T lymphotropic virus, lymphocytic choriomeningitis virus, respiratory syncytial virus, and/or rhinovirus. In some embodiments, the bacterial infection is selected from the group consisting of *Helicobacter* spp., *Mycobacterium* spp., *Porphyromonas* spp., *Chlamydia* spp., *Salmonella* spp., *Listeria* spp., *Streptococcus* spp., *Haemophilus* spp., *Neisseria* spp., *Klebsiella* spp., *Borrelia* spp., *Bacterioides* spp., and *Treponema* spp. In some embodiments, the protozoan infection is selected from the group consisting of *Leishmania* spp., *Plasmodium falciparum*, *Schistosoma* spp., *Toxoplasma* spp., *Trypanosoma* spp., and *Taenia* spp. In some embodiments, the fungal infection is selected from the group consisting of blastomycosis, coccidioiodmycosis, histoplamsosis, candidiasis, cryptococcosis, aspergillossi, mucomycosis and pneumocystosis.

In some embodiments, the disease or disorder is an inflammatory disease. In some embodiments, the inflammatory disease is selected from the group consisting of acute disseminated encephalomyelitis, Addison's disease, Alzheimer's disease, ankylosing spondylitis, antiphospholipid antibody syndrome, atherosclerosis, autoimmune hemolytic anemia, autoimmune hepatitis, arthritis, Behcet's disease, Berger's disease, Bullous pemphigoid, Celiac disease, Chagas' disease, cholangitis, Crohn's disease, Dermatomyositis, Diabetes mellitus type 1, glomerulonephritis, Goodpasture's syndrome, graft-versus-host disease, Graves' disease, Guillain-Barré syndrome, Hashimoto's disease, hives, hyper IgE syndrome, idiopathic thrombocytopenic purpura, lupus erythematosus, lupus nephritis, multiple sclerosis, myasthenia gravis, organ transplant rejection, Parkinson's disease, pemphigus, pernicious anaemia, polymyositis, primary biliary cirrhosis, psoriasis, Raynaud's syndrome, rheumatoid arthritis, scleroderma, Sjögren's syndrome, temporal arteritis, thyroiditis, ulcerative colitis, uveitis, vasculitis, and Wegener's granulomatosis.

In some embodiments, the formulation containing the antibody may be administered in conjunction with another therapeutic agent to a subject or an individual for treating a disease or disorder. For example, for treating cancer, the self-crosslinking antibody formulation described herein may administered in conjunction with another anti-cancer treatment (e.g., a chemotherapy or a different antibody treatment).

V. ARTICLES OF MANUFACTURE OR KITS

Also provided herein are articles of manufacture or kits comprising a container which holds the aqueous pharmaceutical formulation of any of the embodiments described herein and optionally provides instructions for its use. Suitable containers include, for example, bottles, vials, bags and syringes. The container may be formed from a variety of materials such as glass, plastic (such as polyvinyl chloride or polyolefin), or metal alloy (such as stainless steel or hastelloy). An exemplary container is a 300 cc metal alloy container (e.g., for storing at −20° C.). Another exemplary container may be 10-50 cc glass vial (e.g., for storing at 2-8° C.). For example, the container may be 10 cc, 15 cc, 20 cc, or 50 cc glass vials. The container holds the formulation and the label on, or associated with, the container may indicate directions for use. The article of manufacture may further include other materials desirable from a commercial and user standpoint, including other buffers, diluents, filters, needles, syringes, and package inserts with instructions for use. In some embodiments, the article of manufacture further includes one or more of another agent (e.g., a chemotherapeutic agent, and anti-neoplastic agent). Suitable containers for the one or more agent include, for example, bottles, vials, bags and syringes.

Having described the invention with reference to the embodiments and illustrative examples, those in the art may appreciate modifications to the invention as described and illustrated that do not depart from the spirit and scope of the invention as disclosed in the specification. The Examples are set forth to aid in understanding the invention but are not intended to, and should not be construed to limit its scope in any way. The examples do not include detailed descriptions of conventional methods. Such methods are well known to those of ordinary skill in the art and are described in numerous publications. Further, all references cited above and in the examples below are hereby incorporated by reference in their entirety, as if fully set forth herein.

The following documents are hereby incorporated by reference in their entirety for all purposes: U.S. Application Ser. No. 61/597,708, filed Feb. 10, 2012; U.S. application Ser. No. 13/270,207, filed Oct. 10, 2011, now U.S. Pat. No. 8,658,774; International Application Number PCT/US2011/055656 filed Oct. 10, 2011; International Application Number PCT/US12/32938 filed Apr. 10, 2012; U.S. application Ser. No. 13/443,804, filed Apr. 10, 2012, now U.S. Pat. No. 8,962,804; U.S. Application Ser. No. 61/749,830, filed Feb. 10, 2012, and U.S. application Ser. No. 13/764,762, filed Feb. 11, 2013.

VI. DEFINITIONS

An "antibody," as used herein, refers to an immunoglobulin molecule that specifically binds to, or is immunologically reactive with an antigen or epitope, and includes both polyclonal and monoclonal antibodies, as well as functional antibody fragments, including but not limited to fragment antigen binding (Fab) fragments, $F(ab')_2$ fragments, Fab' fragments, Fv fragments, recombinant IgG (rIgG) fragments, single chain variable fragments (scFv) and single domain antibodies (e.g., sdAb, sdFv, nanobody) fragments. The term "antibody" includes genetically engineered or otherwise modified forms of immunoglobulins, such as intrabodies, peptibodies, chimeric antibodies, fully human antibodies, humanized antibodies, meditope-enabled antibodies and heteroconjugate antibodies (e.g., bispecific antibodies, diabodies, triabodies, tetrabodies, tandem di-scFv, tandem tri-scFv). Unless otherwise stated, the term "antibody" should be understood to encompass functional antibody fragments thereof.

The terms "complementarity determining region," and "CDR," are known in the art to refer to non-contiguous sequences of amino acids within antibody variable regions, which confer antigen specificity and binding affinity. In general, there are three CDRs in each heavy chain variable region (CDR-H1, CDR-H2, CDR-H3) and three CDRs in each light chain variable region (CDR-L1, CDR-L2, CDR-L3). "Framework regions" and "FR" are known in the art to refer to the non-CDR portions of the variable regions of the heavy and light chains. In general, there are four FRs in each heavy chain variable region (FR-H1, FR-H2, FR-H3, and FR-H4), and four FRs in each light chain variable region (FR-L1, FR-L2, FR-L3, and FR-L4).

The precise amino acid sequence boundaries of a given CDR or FR can be readily determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273,927-948 ("Chothia" numbering scheme), MacCallum et al., J. Mol. Biol. 262: 732-745 (1996), "Antibody-antigen interactions: Contact analysis and binding site topography," J. Mol. Biol. 262, 732-745." (Contact" numbering scheme), Lefranc M P et al., "IMGT unique numbering for immunoglobulin and T cell receptor variable domains and Ig superfamily V-like domains," Dev Comp Immunol, 2003 January; 27(1):55-77 ("IMGT" numbering scheme), and Honegger A and Pluckthun A, "Yet another numbering scheme for immunoglobulin variable domains: an automatic modeling and analysis tool," J Mol Biol, 2001 Jun. 8; 309(3):657-70, (AHo numbering scheme).

The boundaries of a given CDR or FR may vary depending on the scheme used for identification. For example, the Kabat scheme is based structural alignments, while the Chothia scheme is based on structural information. Numbering for both the Kabat and Chothia schemes is based upon the most common antibody region sequence lengths, with insertions accommodated by insertion letters, for example, "30a," and deletions appearing in some antibodies. The two schemes place certain insertions and deletions ("indels") at different positions, resulting in differential numbering. The Contact scheme is based on analysis of complex crystal structures and is similar in many respects to the Chothia numbering scheme.

Table 4, below, lists the positions of CDR-L1, CDR-L2, CDR-L3 and CDR-H1, CDR-H2, CDR-H3 as identified by the Kabat, Chothia, and Contact schemes, respectively. For CDR-H1, residue numbering is given listed using both the Kabat and Chothia numbering schemes. It is noted that because the Kabat numbering scheme places insertions at H35A and H35B, the end of the Chothia CDR-H1 loop when numbered using the Kabat numbering convention varies between H32 and H34, depending on the length of the loop.

TABLE 4

| CDR | Kabat | Chothia | Contact |
| --- | --- | --- | --- |
| CDR-L1 | L24 - - - L34 | L24 - - - L34 | L30 - - - L36 |
| CDR-L2 | L50 - - - L56 | L50 - - - L56 | L46 - - - L55 |
| CDR-L3 | L89 - - - L97 | L89 - - - L97 | L89 - - - L96 |
| CDR-H1 (Kabat Numbering[1]) | H31 - - - H35B | H26 - - - H32 . . . 34 | H30 - - - H35B |
| CDR-H1 (Chothia Numbering[2]) | H31 - - - H35 | H26 - - - H32 | H30 - - - H35 |
| CDR-H2 | H50 - - - H65 | H52 - - - H56 | H47 - - - H58 |
| CDR-H3 | H95 - - - H102 | H95 - - - H102 | H93 - - - H101 |

[1]Kabat et al. (1991), "Sequences of Proteins of Immunological Interest," 5th Ed. Public Health Service, National Institutes of Health, Bethesda, MD
[2]Al-Lazikani et al., (1997) JMB 273, 927-948

Thus, unless otherwise specified, a "CDR" or "complementary determining region," or individual specified CDRs (e.g., "CDR-H1, CDR-H2), of a given antibody or region thereof, such as a variable region thereof, should be understood to encompass a (or the specific) complementary determining region as defined by any of the known schemes. Likewise, unless otherwise specified, a "FR" or "framework region," or individual specified FRs (e.g., "FR-H1, FR-H2), of a given antibody or region thereof, such as a variable region thereof, should be understood to encompass a (or the specific) framework region as defined by any of the known schemes. In some instances, the scheme for identification of a particular CDR, FR, or FRs or CDRs is specified, such as the CDR as defined by the Kabat, Chothia, or Contact method. In other cases, the particular amino acid sequence of a CDR or FR is given.

The term "meditope-enabled" antibody and "meditope enabled antibody" and "meditope enabled antibody" refer to an antibody or functional fragment thereof that is able to bind to a meditope, via a meditope binding site. Examples of meditope-enabled antibodies include, but are not limited to, cetuximab and others described herein. A "meditope binding site" is a region of the meditope-enabled antibody containing the amino acid residues that interact with a bound meditope, which residues include framework region (FR) residues of the heavy and light chains. With reference to a Fab fragment or a Fab portion of an antibody, the meditope binding site is located within the central cavity of the Fab fragment or portion.

The "central cavity," with respect to the three-dimensional structure of a Fab, refers to the internal cavity of the Fab, lined by portions of the heavy and light chain variable and constant regions. The central cavity thus is lined by residues of the VH, VL, CH1, and CL regions and does not include the antigen binding site.

In some embodiments, the meditope binding site includes residues 40, 41, 83, and 85 of the light chain of a meditope-enabled antibody, according to Kabat numbering, and/or residues 39, 89, 105, and 108 of the heavy chain of the meditope-enabled antibody, according to Kabat numbering.

In some embodiments, the meditope binding site is located within a cavity formed by residues 8, 9, 10, 38, 39, 40, 41 42, 43, 44, 45, 82, 83, 84, 85, 86, 87, 99, 100, 101, 102, 103, 104, 105, 142, 162, 163, 164, 165, 166, 167, 168, and 173 of the light chain and 6, 9, 38, 39, 40, 41, 42, 43, 44, 45, 84, 86, 87, 88, 89, 90, 91, 103, 104, 105, 106, 107, 108, 111, 110, 147, 150, 151, 152, 173, 174, 175, 176, 177, 185, 186, and 187 of the heavy chain of the antibody, according to Kabat numbering.

With respect to a Fab portion of a meditope-enabled antibody, the meditope binding site includes residues within the central cavity. The meditope-binding site typically further includes constant region residues.

A "therapeutic agent," as used herein, is an atom, molecule, or compound that is useful in treatment of a disease or condition.

A "therapeutically effective amount," "therapeutically effective concentration" or "therapeutically effective dose" is the amount of a compound that produces a desired therapeutic effect in a subject, such as preventing or treating a target condition, alleviating symptoms associated with the condition, producing a desired physiological effect, or allowing imaging or diagnosis of a condition that leads to treatment of the disease or condition. The precise therapeutically effective amount is the amount of the composition that will yield the most effective results in terms of efficacy of treatment in a given subject. This amount will vary depending upon a variety of factors, including, but not limited to, the characteristics of the therapeutic compound (including activity, pharmacokinetics, pharmacodynamics, and bioavailability), the physiological condition of the subject (including age, sex, disease type and stage, general physical condition, responsiveness to a given dosage, and type of medication), the nature of the pharmaceutically acceptable carrier or carriers in the formulation, and the route of administration. One skilled in the clinical and pharmacological arts will be able to determine a therapeutically effective amount through routine experimentation, namely by monitoring a subject's response to administration of a compound and adjusting the dosage accordingly. For instance, in some embodiment, the therapeutically effective amount of an antibody is from a about 1 to about 1000 mg/m², or alternatively from 1 to about 1000 mg/m², from 1 to about 1000 mg/m², from 1 to about 1000 mg/m², from 10 to about 900 mg/m², from 20 to about 800 mg/m², from 30 to about 700 mg/m², from 40 to about 600 mg/m², from 50 to about 500 mg/m², from 100 to about 400 mg/m², from 1 to about 500 mg/m², from 10 to about 400 mg/m², from 50 to about 300 mg/m², from 100 to about 1000 mg/m², from 150 to about 900 mg/m², from 200 to about 800 mg/m², from 250 to about 700 mg/m². For additional guidance, see Remington: The Science and Practice of Pharmacy 21$^{st}$ Edition, Univ. of Sciences in Philadelphia (USIP), Lippincott Williams & Wilkins, Philadelphia, Pa., 2005.

A "pharmaceutically acceptable carrier" refers to a pharmaceutically acceptable material, composition, or vehicle that is involved in carrying or transporting a compound of interest from one tissue, organ, or portion of the body to another tissue, organ, or portion of the body. For example, the carrier may be a liquid or solid filler, diluent, excipient, solvent, or encapsulating material, or some combination thereof. Each component of the carrier must be "pharmaceutically acceptable" in that it must be compatible with the other ingredients of the formulation. It also must be suitable for contact with any tissue, organ, or portion of the body that it may encounter, meaning that it must not carry a risk of toxicity, irritation, allergic response, immunogenicity, or any other complication that outweighs its therapeutic benefits.

A "route of administration" may refer to any administration pathway known in the art, including but not limited to aerosol, enteral, nasal, ophthalmic, oral, parenteral, rectal, transdermal, or vaginal. "Transdermal" administration may be accomplished using a topical cream or ointment or by means of a transdermal patch. "Parenteral" refers to a route of administration that is generally associated with injection, including infraorbital, infusion, intraarterial, intracapsular, intracardiac, intradermal, intramuscular, intraperitoneal, intrapulmonary, intraspinal, intrasternal, intrathecal, intrauterine, intravenous, subarachnoid, subcapsular, subcutaneous, transmucosal, or transtracheal.

"In combination" or "in combination with," when used herein in the context of multiple agents, therapeutics, or treatments, means in the course of treating the same disease or condition in a subject administering two or more agents, drugs, treatment regimens, treatment modalities or a combination thereof (e.g., an antibody in combination with a meditope or a meditope), in any order. This includes simultaneous administration (or "coadministration"), administration of a first agent prior to or after administration of a second agent, as well as in a temporally spaced order of up to several days apart. Such combination treatment may also include more than a single administration of any one or more of the agents, drugs, treatment regimens or treatment modalities. Further, the administration of the two or more agents, drugs, treatment regimens, treatment modalities or a combination thereof may be by the same or different routes of administration.

A "therapeutic antibody" may refer to any antibody or functional fragment thereof that is used to treat cancer, autoimmune diseases, transplant rejection, cardiovascular disease or other diseases or conditions such as those described herein. Examples of therapeutic antibodies that may be used according to the embodiments described herein include, but are not limited to murine antibodies, murinized or humanized chimera antibodies or human antibodies including, but not limited to, Erbitux (cetuximab), ReoPro (abciximab), Simulect (basiliximab), Remicade (infliximab); Orthoclone OKT3 (muromonab-CD3); Rituxan (rituximab), Bexxar (tositumomab) Humira (adalimumab), Campath (alemtuzumab), Simulect (basiliximab), Avastin (bevacizumab), Cimzia (certolizumab pegol), Zenapax (daclizumab), Soliris (eculizumab), Raptiva (efalizumab), Mylotarg (gemtuzumab), lintuzumab, Zevalin (ibritumomab tiuxetan), Tysabri (natalizumab), Xolair (omalizumab), Synagis (palivizumab), Vectibix (panitumumab), Lucentis (ranibizumab), and Herceptin (trastuzumab).

"Treating" or "treatment" of a condition may refer to preventing the condition, slowing the onset or rate of development of the condition, reducing the risk of developing the condition, preventing or delaying the development of symptoms associated with the condition, reducing or ending symptoms associated with the condition, generating a complete or partial regression of the condition, or some combination thereof.

As used herein, the terms "including," "containing," and "comprising" are used in their open, non-limiting sense.

As used herein, the singular forms "a," "an," and "the" include plural referents unless the context clearly dictates otherwise.

To provide a more concise description, some of the quantitative expressions given herein are not qualified with the term "about". It is understood that, whether the term "about" is used explicitly or not, every quantity given herein is meant to refer to the actual given value, and it is also meant to refer to the approximation to such given value that would reasonably be inferred based on the ordinary skill in the art, including equivalents and approximations due to the experimental and/or measurement conditions for such given value.

As used herein, "alkyl" refers to a saturated, straight- or branched-chain hydrocarbon group having from 1 to 12 carbon atoms. Representative alkyl groups include, but are not limited to, methyl, ethyl, n-propyl, isopropyl, 2-methyl-1-propyl, 2-methyl-2-propyl, 2-methyl-1-butyl, 3-methyl-1-butyl, 2-methyl-3-butyl, 2,2-dimethyl-1-propyl, 2-methyl-1-pentyl, 3-methyl-1-pentyl, 4-methyl-1-pentyl, 2-methyl-2-pentyl, 3-methyl-2-pentyl, 4-methyl-2-pentyl, 2,2-dimethyl-1-butyl, 3,3-dimethyl-1-butyl, 2-ethyl-1-butyl, butyl, isobutyl, t-butyl, n-pentyl, isopentyl, neopentyl, n-hexyl, and the like, and longer alkyl groups, such as heptyl, octyl, and the like. The term "$C_{x-y}$alkyl," where x and y are integers, refers to an alkyl with x-y carbon atoms.

As used herein, an "alkenyl" refers to a straight- or branched-chain hydrocarbon group having one or more double bonds therein and having from 2 to 12 carbon atoms. Illustrative alkenyl groups include, but are not limited to, ethylenyl, vinyl, allyl, butenyl, pentenyl, hexenyl, butadienyl, pentadienyl, hexadienyl, 2-ethylhexenyl, 2-propyl-2-butenyl, 4-(2-methyl-3-butene)-pentenyl, and the like. The term "$C_{x-y}$alkenyl," where x and y are integers, refers to an alkenyl with x-y carbon atoms.

The term "alkylenyl" or "alkylene" refers to a divalent alkyl group. The term "alkenylene" or "alkenylene" refers to a divalent alkenyl group.

As used herein, "alkynyl" refers to a straight- or branched-chain hydrocarbon group having one or more triple bonds therein and having from 2 to 10 carbon atoms. Exemplary alkynyl groups include, but are not limited to, ethynyl, propynyl, butynyl, pentynyl, hexynyl, methylpropynyl, 4-methyl-1-butynyl, 4-propyl-2-pentynyl, 4-butyl-2-hexynyl, and the like.

The term "heteroalkyl," by itself or in combination with another term, means, unless otherwise stated, a stable straight or branched chain, or combinations thereof, including at least one carbon atom and at least one heteroatom selected from the group consisting of O, N, P, Si, and S, and wherein the nitrogen and sulfur atoms may optionally be oxidized, and the nitrogen heteroatom may optionally be quaternized. The heteroatom(s) O, N, P, S, and Si may be placed at any interior position of the heteroalkyl group or at the position at which the alkyl group is attached to the remainder of the molecule. Examples include, but are not limited to: —$CH_2$—$CH_2$—O—$CH_3$, —$CH_2$—$CH_2$—NH—$CH_3$, —$CH_2$—$CH_2$—N($CH_3$)—$CH_3$, —$CH_2$—S—$CH_2$—$CH_3$, —$CH_2$—$CH_2$, —S(O)—$CH_3$, —$CH_2$—$CH_2$—S(O)$_2$—$CH_3$, —CH=CH—O—$CH_3$, —Si($CH_3$)$_3$, —$CH_2$—CH=N—$OCH_3$, —C H=CH—N($CH_3$)—$CH_3$, —O—$CH_3$, —O—$CH_2$—$CH_3$, and —CN. Up to two or three heteroatoms may be consecutive, such as, for example, —$CH_2$—NH—$OCH_3$ and —$CH_2$—O—Si($CH_3$)$_3$.

Similarly, the term "heteroalkylene," by itself or as part of another substituent, means, unless otherwise stated, a divalent radical derived from heteroalkyl, as exemplified, but not limited by, —$CH_2$—$CH_2$—S—$CH_2$—$CH_2$— and —$CH_2$—S—$CH_2$—$CH_2$—NH—$CH_2$—. For heteroalkylene groups, heteroatoms can also occupy either or both of the chain termini (e.g., alkyleneoxy, alkylenedioxy, alkyleneamino, alkylenediamino, and the like). Still further, for alkylene and heteroalkylene linking groups, no orientation of the linking group is implied by the direction in which the formula of the linking group is written. For example, the formula —C(O)$_2$R'— represents both —C(O)$_2$R'— and —R'C(O)$_2$—. As described above, heteroalkyl groups, as used herein, include those groups that are attached to the remainder of the molecule through a heteroatom, such as —C(O)R', —C(O)NR', —NR'R", —OR', —SR', and/or —SO$_2$R'. Where "heteroalkyl" is recited, followed by recitations of specific heteroalkyl groups, such as —NR'R" or the like, it will be understood that the terms heteroalkyl and —NR'R" are not redundant or mutually exclusive. Rather, the specific heteroalkyl groups are recited to add clarity. Thus, the term "heteroalkyl" should not be interpreted herein as excluding specific heteroalkyl groups, such as —NR'R" or the like.

The terms "cycloalkyl" and "heterocycloalkyl," by themselves or in combination with other terms, mean, unless otherwise stated, cyclic versions of "alkyl" and "heteroalkyl," respectively. Additionally, for heterocycloalkyl, a heteroatom can occupy the position at which the heterocycle is attached to the remainder of the molecule. Examples of cycloalkyl include, but are not limited to, cyclopropyl, cyclobutyl, cyclopentyl, cyclohexyl, 1-cyclohexenyl, 3-cyclohexenyl, cycloheptyl, and the like. Examples of heterocycloalkyl include, but are not limited to, 1-(1,2,5,6-tetrahydropyridyl), 1-piperidinyl, 2-piperidinyl, 3-piperidinyl, 4-morpholinyl, 3-morpholinyl, tetrahydrofuran-2-yl, tetrahydrofuran-3-yl, tetrahydrothien-2-yl, tetrahydrothien-3-yl, 1-piperazinyl, 2-piperazinyl, and the like. A "cycloalkylene" and a "heterocycloalkylene," alone or as part of another substituent, means a divalent radical derived from a cycloalkyl and heterocycloalkyl, respectively.

The term "aryl" means, unless otherwise stated, a polyunsaturated, aromatic, hydrocarbon substituent, which can be a single ring or multiple rings (preferably from 1 to 3 rings) that are fused together (i.e., a fused ring aryl) or linked covalently. A fused ring aryl refers to multiple rings fused together wherein at least one of the fused rings is an aryl ring. The term "heteroaryl" refers to aryl groups (or rings) that contain at least one heteroatom such as N, O, or S, wherein the nitrogen and sulfur atoms are optionally oxidized, and the nitrogen atom(s) are optionally quaternized. Thus, the term "heteroaryl" includes fused ring heteroaryl groups (i.e., multiple rings fused together wherein at least one of the fused rings is a heteroaromatic ring). A 5,6-fused ring heteroarylene refers to two rings fused together, wherein one ring has 5 members and the other ring has 6 members, and wherein at least one ring is a heteroaryl ring. Likewise, a 6,6-fused ring heteroarylene refers to two rings fused together, wherein one ring has 6 members and the other ring has 6 members, and wherein at least one ring is a heteroaryl ring. A 6,5-fused ring heteroarylene refers to two rings fused together, wherein one ring has 6 members and the other ring has 5 members, and wherein at least one ring is a heteroaryl ring. A heteroaryl group can be attached to the remainder of the molecule through a carbon or heteroatom. Non-limiting examples of aryl and heteroaryl groups include phenyl, 1-naphthyl, 2-naphthyl, 4-biphenyl, 1-pyrrolyl, 2-pyrrolyl, 3-pyrrolyl, 3-pyrazolyl, 2-imidazolyl, 4-imidazolyl, pyrazinyl, 2-oxazolyl, 4-oxazolyl, 2-phenyl-4-oxazolyl, 5-oxazolyl, 3-isoxazolyl, 4-isoxazolyl, 5-isoxazolyl, 2-thiazolyl, 4-thiazolyl, 5-thiazolyl, 2-furyl, 3-furyl, 2-thienyl, 3-thienyl, 2-pyridyl, 3-pyridyl, 4-pyridyl, 2-pyrimidyl, 4-pyrimidyl, 5-benzothiazolyl, purinyl, 2-benzimidazolyl, 5-indolyl, 1-isoquinolyl, 5-isoquinolyl, 2-quinoxalinyl, 5-quinoxalinyl, 3-quinolyl, and 6-quinolyl. Substituents for each of the above noted aryl and heteroaryl ring systems are selected from the group of acceptable substituents described below. An "arylene" and a "heteroarylene," alone or as part of another substituent, mean a divalent radical derived from an aryl and heteroaryl, respectively. Non-limiting examples of heteroaryl groups include pyridinyl, pyrimidinyl, thiophenyl, furanyl, indolyl, benzoxadiazolyl, benzodioxolyl, benzodioxanyl, thianaphthanyl, pyrrolopyridinyl, indazolyl, quinolinyl, quinoxalinyl, pyridopyrazinyl, quinazolinonyl, benzoisoxazolyl, imidazopyridinyl, benzofuranyl, benzothiophenyl, phenyl, naphthyl, biphenyl, pyrrolyl, pyrazolyl, imidazolyl, pyrazinyl, oxazolyl, isoxazolyl, thiazolyl, furylthienyl, pyridyl, pyrimidyl, benzothiazolyl, purinyl, benzimidazolyl, isoquinolyl, thiadiazolyl, oxadiazolyl, pyrrolyl, diazolyl, triazolyl, tetrazolyl, benzothiadiazolyl, isothiazolyl, pyrazolopyrimidinyl, pyrrolopyrimidinyl, benzotriazolyl, benzoxazolyl, or quinolyl. The examples above may be substituted or unsubstituted and divalent radicals of each heteroaryl example above are non-limiting examples of heteroarylene.

The term "boronic ester" refers to a substituent —B(OR)$_2$, wherein each R group is independently a $C_{1-4}$alkyl, or the two R groups taken together form a $C_{2-6}$alkylene.

The term "acetal" refers to a —CH(OR)$_2$ group, wherein each R group is independently a $C_{1-4}$alkyl, or the two R groups taken together form a $C_{2-6}$alkylene. Exemplary acetal groups include dimethylacetal or diethylacetal, or a cyclic acetal. The term "ketal" refers to a —C(OR)$_2$— group, wherein each R group is independently a $C_{1-4}$alkyl, or the two R groups taken together form a $C_{2-6}$alkylene. Exemplary ketals include dimethylketal or diethylketal, or a cyclic ketal.

The term "halo" represents chloro, fluoro, bromo, or iodo. In some embodiments, halo is chloro, fluoro, or bromo. The term "halogen" as used herein refers to fluorine, chlorine, bromine, or iodine. The term "ortho ester" refers to a —C(OR)$_3$ group, wherein each R group is independently a $C_{1-4}$alkyl, or two of the R groups taken together form a $C_{2-6}$alkylene. The term "oxo" means an =O group and may be attached to a carbon atom or a sulfur atom. The term "phosphonate ester" refers to a —P(O)(OR)$_2$ group, wherein each R group is independently a $C_{1-4}$alkyl, or the two R groups taken together form a $C_{2-6}$alkylene.

As used herein, the term "cycloalkyl" refers to a saturated or partially saturated, monocyclic, fused polycyclic, bridged polycyclic, or spiro polycyclic carbocycle having from 3 to 15 ring carbon atoms. A non-limiting category of cycloalkyl groups are saturated or partially saturated, monocyclic carbocycles having from 3 to 6 carbon atoms. Illustrative examples of cycloalkyl groups include, but are not limited to, the following moieties:

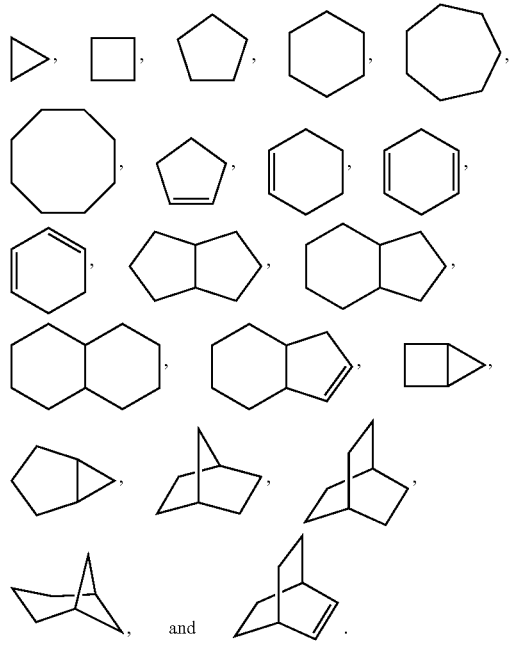

As used herein, the term "5-membered heteroaryl" refers to a monocyclic, aromatic heterocycle having five ring atoms that are selected from carbon, oxygen, nitrogen, and sulfur. Examples of 5-membered heteroaryl groups include, but are not limited to, imidazolyl, pyrazolyl, triazolyl, tetrazolyl, furanyl, thienyl, isoxazolyl, thiazolyl, oxazolyl, isothiazolyl, pyrrolyl, and thiadiazolyl. Particular examples of 5-membered heteraryls include those that may be formed by 1,3-cycloaddition reactions such as a Huisgen reaction between an azide and a propargyl group.

As used herein, the term "substituted" means that the specified group or moiety bears one or more suitable substituents. As used herein, the term "unsubstituted" means that the specified group bears no substituents. As used herein, the term "optionally substituted" means that the specified group is unsubstituted or substituted by the specified number of substituents. Where the term "substituted" is used to describe a structural system, the substitution is meant to occur at any valency-allowed position on the system. As used herein, the expression "one or more substituents" denotes one to maximum possible number of substitution(s) that can occur at any valency-allowed position on the system. In a certain embodiment, "one or more substituents" means 1, 2, 3, 4, or 5 substituents. In another embodiment, one or more substituent means 1, 2, or 3 substituents.

A "substituent group" or "substituent" as used herein, means a group selected from the following moieties:
(A) oxo, halogen, —CF$_3$, —CN, —OH, —NH$_2$, —COOH, —CONH$_2$, —NO$_2$, —SH, —SO$_2$Cl, —SO$_3$H, —SO$_4$H, —SO$_2$NH$_2$, —NHNH$_2$, —ONH$_2$, —NHC=(O)NHNH$_2$, —NHC=(O) NH$_2$, —NHSO$_2$H, —NHC=(O)H, —NHC(O)—OH, —NHOH, —OCF$_3$, —OCHF$_2$, unsubstituted alkyl, unsubstituted heteroalkyl, unsubstituted cycloalkyl, unsubstituted heterocycloalkyl, unsubstituted aryl, unsubstituted heteroaryl, and
(B) alkyl, heteroalkyl, cycloalkyl, heterocycloalkyl, aryl, and heteroaryl, substituted with at least one substituent selected from:
  i. oxo, halogen, —CF$_3$, —CN, —OH, —NH$_2$, —COOH, —CONH$_2$, —NO$_2$, —SH, —SO$_2$Cl, —SO$_3$H, —SO$_4$H, —SO$_2$NH$_2$, —NHNH$_2$, —ONH$_2$, —NHC=(O)NHNH$_2$, —NHC=(O) NH$_2$, —NHSO$_2$H, —NHC=(O)H, —NHC(O)—OH, —NHOH, —OCF$_3$, —OCHF$_2$, unsubstituted alkyl, unsubstituted heteroalkyl, unsubstituted cycloalkyl, unsubstituted heterocycloalkyl, unsubstituted aryl, unsubstituted heteroaryl, and
  ii. alkyl, heteroalkyl, cycloalkyl, heterocycloalkyl, aryl, and heteroaryl, substituted with at least one substituent selected from:
    1. oxo,
      halogen, —CF$_3$, —CN, —OH, —NH$_2$, —COOH, —CONH$_2$, —NO$_2$, —SH, —SO$_2$Cl, —SO$_3$H, —SO$_4$H, —SO$_2$NH$_2$, —NHNH$_2$, —ONH$_2$, —NHC=(O)NHNH$_2$, —NHC=(O) NH$_2$, —NHSO$_2$H, —NHC=(O)H, —NHC(O)—OH, —NHOH, —OCF$_3$, —OCHF$_2$, unsubstituted alkyl, unsubstituted heteroalkyl, unsubstituted cycloalkyl, unsubstituted heterocycloalkyl, unsubstituted aryl, unsubstituted heteroaryl, and
    2. alkyl, heteroalkyl, cycloalkyl, heterocycloalkyl, aryl, or heteroaryl, substituted with at least one substituent selected from: oxo,
      halogen, —CF$_3$, —CN, —OH, —NH$_2$, —COOH, —CONH$_2$, —NO$_2$, —SH, —SO$_2$Cl, —SO$_3$H, —SO$_4$H, —SO$_2$NH$_2$, —NHNH$_2$, —ONH$_2$, —NHC=(O)NHNH$_2$, —NHC=(O) NH$_2$, —NHSO$_2$H, —NHC=(O)H, —NHC(O)—OH, —NHOH, —OCF$_3$, —OCHF$_2$, unsubstituted alkyl, unsubstituted heteroalkyl, unsubstituted cycloalkyl, unsubstituted heterocycloalkyl, unsubstituted aryl, and unsubstituted heteroaryl.

A "size-limited substituent" or "size-limited substituent group," as used herein, means a group selected from all of the substituents described above for a "substituent group" wherein each substituted or unsubstituted alkyl is a substituted or unsubstituted $C_1$-$C_{20}$ alkyl, each substituted or unsubstituted heteroalkyl is a substituted or unsubstituted 2 to 20 membered heteroalkyl, each substituted or unsubstituted cycloalkyl is a substituted or unsubstituted $C_3$-$C_8$ cycloalkyl, each substituted or unsubstituted heterocycloalkyl is a substituted or unsubstituted 3 to 8 membered heterocycloalkyl, each substituted or unsubstituted aryl is a substituted or unsubstituted $C_6$-$C_{10}$ aryl, and each substituted or unsubstituted heteroaryl is a substituted or unsubstituted 5 to 10 membered heteroaryl. A "lower substituent" or "lower substituent group," as used herein, means a group selected from all of the substituents described above for a "substituent group," wherein each substituted or unsubstituted alkyl is a substituted or unsubstituted $C_1$-$C_8$ alkyl, each substituted or unsubstituted heteroalkyl is a substituted or unsubstituted 2 to 8 membered heteroalkyl, each substituted or unsubstituted cycloalkyl is a substituted or unsubstituted $C_3$-$C_7$ cycloalkyl, each substituted or unsubstituted heterocycloalkyl is a substituted or unsubstituted 3 to 7 membered heterocycloalkyl, each substituted or unsubstituted aryl is a substituted or unsubstituted $C_6$-$C_{10}$ aryl, and each substituted or unsubstituted heteroaryl is a substituted or unsubstituted 5 to 9 membered heteroaryl.

In some embodiments, each substituted group described in the compounds herein is substituted with at least one substituent group. More specifically, in some embodiments, each substituted alkyl, substituted heteroalkyl, substituted cycloalkyl, substituted heterocycloalkyl, substituted aryl, substituted heteroaryl, substituted alkylene, substituted heteroalkylene, substituted cycloalkylene, substituted heterocycloalkylene, substituted arylene, and/or substituted heteroarylene described in the compounds herein are substituted with at least one substituent group. In other embodiments, at least one or all of these groups are substituted with at least one size-limited substituent group. In other embodiments, at least one or all of these groups are substituted with at least one lower substituent group.

In other embodiments herein, each substituted or unsubstituted alkyl may be a substituted or unsubstituted $C_1$-$C_{20}$ alkyl, each substituted or unsubstituted heteroalkyl is a substituted or unsubstituted 2 to 20 membered heteroalkyl, each substituted or unsubstituted cycloalkyl is a substituted or unsubstituted $C_3$-$C_8$ cycloalkyl, each substituted or unsubstituted heterocycloalkyl is a substituted or unsubstituted 3 to 8 membered heterocycloalkyl, each substituted or unsubstituted aryl is a substituted or unsubstituted $C_6$-$C_{10}$ aryl, and/or each substituted or unsubstituted heteroaryl is a substituted or unsubstituted 5 to 10 membered heteroaryl. In some embodiments of the compounds herein, each substituted or unsubstituted alkylene is a substituted or unsubstituted $C_1$-$C_{20}$ alkylene, each substituted or unsubstituted heteroalkylene is a substituted or unsubstituted 2 to 20 membered heteroalkylene, each substituted or unsubstituted cycloalkylene is a substituted or unsubstituted $C_3$-$C_8$ cycloalkylene, each substituted or unsubstituted heterocycloalkylene is a substituted or unsubstituted 3 to 8 membered heterocycloalkylene, each substituted or unsubstituted arylene is a substituted or unsubstituted $C_6$-$C_{10}$ arylene, and/or each substituted or unsubstituted heteroarylene is a substituted or unsubstituted 5 to 10 membered heteroarylene.

In some embodiments, each substituted or unsubstituted alkyl is a substituted or unsubstituted $C_1$-$C_8$ alkyl, each substituted or unsubstituted heteroalkyl is a substituted or unsubstituted 2 to 8 membered heteroalkyl, each substituted or unsubstituted cycloalkyl is a substituted or unsubstituted $C_3$-$C_7$ cycloalkyl, each substituted or unsubstituted heterocycloalkyl is a substituted or unsubstituted 3 to 7 membered heterocycloalkyl, each substituted or unsubstituted aryl is a substituted or unsubstituted $C_6$-$C_{10}$ aryl, and/or each substituted or unsubstituted heteroaryl is a substituted or unsubstituted 5 to 9 membered heteroaryl. In some embodiments, each substituted or unsubstituted alkylene is a substituted or unsubstituted $C_1$-$C_8$ alkylene, each substituted or unsubstituted heteroalkylene is a substituted or unsubstituted 2 to 8 membered heteroalkylene, each substituted or unsubstituted cycloalkylene is a substituted or unsubstituted $C_3$-$C_7$ cycloalkylene, each substituted or unsubstituted heterocycloalkylene is a substituted or unsubstituted 3 to 7 membered heterocycloalkylene, each substituted or unsubstituted arylene is a substituted or unsubstituted $C_6$-$C_{10}$ arylene, and/or each substituted or unsubstituted heteroarylene is a substituted or unsubstituted 5 to 9 membered heteroarylene.

Any atom that is represented herein with an unsatisfied valence is assumed to have the sufficient number of hydrogen atoms to satisfy the atom's valence. When any variable, such as alkyl, $R^3$, or $R^5$, appears in more than one place in any formula or description provided herein, the definition of that variable on each occurrence is independent of its definition at every other occurrence. Numerical ranges, as used herein, are intended to include sequential whole numbers. For example, a range expressed as "from 0 to 4" or "0-4" includes 0, 1, 2, 3 and 4. When a multifunctional moiety is shown, the point of attachment to the core is indicated by a line or hyphen. For example, —OH refers to a moiety in which an oxygen atom is the point of attachment of the hydroxyl group to the remainder of the molecule.

Any formula given herein is intended to represent compounds having structures depicted by the structural formula as well as certain variations or forms. E.g., compounds of any formula herein may have asymmetric or chiral centers and therefore exist in different stereoisomeric forms. All stereoisomers, including optical isomers, enantiomers, and diastereomers, of the compounds of the general formula, and mixtures thereof, are considered to fall within the scope of the formula. Furthermore, certain structures may exist as geometric isomers (i.e., cis and trans isomers), as tautomers, or as atropisomers. All such isomeric forms, and mixtures thereof, are contemplated herein as part of the present invention. Thus, any formula given herein is intended to represent a racemate, one or more enantiomeric forms, one or more diastereomeric forms, one or more tautomeric or atropisomeric forms, and mixtures thereof.

Diastereomeric mixtures may be separated into their individual diastereomers on the basis of their physical chemical differences by methods well known to those skilled in the art, such as, for example, by chromatography and/or fractional crystallization. Enantiomers may be separated by converting the enantiomeric mixture into a diastereomeric mixture by reaction with an appropriate optically active compound (e.g., chiral auxiliary such as a chiral alcohol or Mosher's acid chloride, or formation of a mixture of diastereomeric salts), separating the diastereomers and converting (e.g., hydrolyzing or de-salting) the individual diastereomers to the corresponding pure enantiomers. Enantiomers may also be separated by use of chiral HPLC column. The chiral centers of compounds of the present invention may be designated as "R" or "S" as defined by the IUPAC 1974 Recommendations, or by "D" or "L" designations consistent with the peptide literature.

As used herein, a box around a portion of a structure, drawn with a subscript, indicates that the structural fragment that appears within the box is repeated according to the subscript. For example, the substructure:

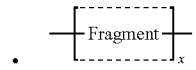

where x is 0, 1, or 2, indicates the fragment is absent from the structure, or is -Fragment-, or is -Fragment-Fragment-. For example, within Formula VII, the following substructure:

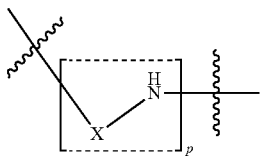

where p is 0 or 1, means that the —X—NH— group within the box is absent from the structure (p is 0), or is present once (p is 1).

The compounds of the invention can form pharmaceutically acceptable salts, which are also within the scope of this invention. A "pharmaceutically acceptable salt" refers to a salt of a free acid or base of a compound described herein that is non-toxic, is physiologically tolerable, is compatible with the pharmaceutical composition in which it is formulated, and is otherwise suitable for formulation and/or administration to a subject. Reference to a compound herein is understood to include reference to a pharmaceutically acceptable salt of said compound unless otherwise indicated.

Compound salts include acidic salts formed with inorganic and/or organic acids, as well as basic salts formed with inorganic and/or organic bases. In addition, where a given compound contains both a basic moiety, such as, but not limited to, a pyridine or imidazole, and an acidic moiety, such as, but not limited to, a carboxylic acid, one of skill in the art will recognize that the compound may exist as a zwitterion ("inner salt"); such salts are included within the term "salt" as used herein. Salts of the compounds of the invention may be prepared, for example, by reacting a compound with an amount of a suitable acid or base, such as an equivalent amount, in a medium such as one in which the salt precipitates or in an aqueous medium followed by lyophilization.

Exemplary salts include, but are not limited, to sulfate, citrate, acetate, oxalate, chloride, bromide, iodide, nitrate, bisulfate, phosphate, acid phosphate, isonicotinate, lactate, salicylate, acid citrate, tartrate, oleate, tannate, pantothenate, bitartrate, ascorbate, succinate, maleate, gentisinate, fumarate, gluconate, glucuronate, saccharate, formate, benzoate, glutamate, methanesulfonate ("mesylate"), ethanesulfonate, benzenesulfonate, p-toluenesulfonate, and pamoate (i.e., 1,1'-methylene-bis(2-hydroxy-3-naphthoate)) salts. A pharmaceutically acceptable salt may involve the inclusion of another molecule such as an acetate ion, a succinate ion or other counterion. The counterion may be any organic or inorganic moiety that stabilizes the charge on the parent compound. Furthermore, a pharmaceutically acceptable salt may have more than one charged atom in its structure. Instances where multiple charged atoms are part of the pharmaceutically acceptable salt can have multiple counterions. Hence, a pharmaceutically acceptable salt can have one or more charged atoms and/or one or more counter ion.

Exemplary acid addition salts include acetates, ascorbates, benzoates, benzenesulfonates, bisulfates, borates, butyrates, citrates, camphorates, camphorsulfonates, fumarates, hydrochlorides, hydrobromides, hydroiodides, lactates, maleates, methanesulfonates, naphthalenesulfonates, nitrates, oxalates, phosphates, propionates, salicylates, succinates, sulfates, tartarates, thiocyanates, toluenesulfonates (also known as tosylates) and the like.

Exemplary basic salts include ammonium salts, alkali metal salts such as sodium, lithium, and potassium salts, alkaline earth metal salts such as calcium and magnesium salts, salts with organic bases (for example, organic amines) such as dicyclohexylamines, t-butyl amines, and salts with amino acids such as arginine, lysine and the like. Basic nitrogen-containing groups may be quaternized with agents such as lower alkyl halides (e.g. methyl, ethyl, and butyl chlorides, bromides and iodides), dialkyl sulfates (e.g. dimethyl, diethyl, and dibutyl sulfates), long chain halides (e.g. decyl, lauryl, and stearyl chlorides, bromides and iodides), aralkyl halides (e.g. benzyl and phenethyl bromides), and others.

Acids and bases generally considered suitable for the formation of pharmaceutically useful salts from pharmaceutical compounds are discussed, e.g., by P. Stahl et al, Camille G. (eds.) Handbook of Pharmaceutical Salts. Properties, Selection and Use. (2002) Zurich: Wiley-VCH; S. Berge et al, Journal of Pharmaceutical Sciences (1977) 66(1) 1-19; P. Gould, International J. of Pharmaceutics (1986) 33 201-217; Anderson et al, The Practice of Medicinal Chemistry (1996), Academic Press, New York; and in The Orange Book (Food & Drug Administration, MD, available from FDA). These disclosures are incorporated herein by reference thereto.

Any compound described herein is intended to refer also to any unsolvated form, or a hydrate, solvate, or polymorph of such a compound, and mixtures thereof, even if such forms are not listed explicitly. "Solvate" means a physical association of a compound of the invention with one or more solvent molecules. This physical association involves varying degrees of ionic and covalent bonding, including hydrogen bonding. In certain instances the solvate will be capable of isolation, for example when one or more solvent molecules are incorporated in the crystal lattice of a crystalline solid. "Solvate" encompasses both solution-phase and isolatable solvates. Suitable solvates include those formed with pharmaceutically acceptable solvents such as water, ethanol, and the like. In some embodiments, the solvent is water and the solvates are hydrates.

Any formula given herein is also intended to represent unlabeled forms as well as isotopically labeled forms of the compounds. Isotopically labeled compounds have structures depicted by the formulas given herein except that one or more atoms are replaced by an atom having a selected atomic mass or mass number. Examples of isotopes that can be incorporated into compounds of the invention include isotopes of hydrogen, carbon, nitrogen, oxygen, phosphorous, fluorine, chlorine, and iodine, such as $^2H$, $^3H$, $^{11}C$, $^{13}C$, $^{14}C$, $^{15}N$, $^{18}O$, $^{17}O$, $^{31}P$, $^{32}P$, $^{35}S$, $^{36}Cl$, and $^{125}I$, respectively. Such isotopically labelled compounds are useful in metabolic studies (for example with $^{14}C$), reaction kinetic studies (with, for example $^2H$ or $^3H$), detection or imaging techniques [such as positron emission tomography (PET) or single-photon emission computed tomography (SPECT)] including drug or substrate tissue distribution assays, or in radioactive treatment of patients. In particular, an $^{18}F$ or $^{11}C$ labeled compound may be particularly suitable for PET or SPECT studies. Further, substitution with heavier isotopes such as deuterium (i.e., $^2H$) may afford certain therapeutic advantages resulting from greater metabolic stability, for example increased in vivo half-life or reduced dosage requirements. Isotopically labeled compounds of this invention and prodrugs thereof can generally be prepared by carrying out the procedures disclosed in the schemes or in the examples and preparations described below by substituting a readily available isotopically labeled reagent for a non-isotopically labeled reagent.

VII. EXAMPLES

The following examples are included for illustrative purposes only and are not intended to limit the scope of the invention.

Example 1 Meditope Fc Binding

A meditope-Fc construct was generated by fusing a meditope to the N-terminus of an Fc domain via a poly-glycine-serine linker. The gene for this meditope-Fc construct was constructed by DNA2.0 (cQFD meditope connected to human IgG gamma heavy chain 3 (accession #AAW65947) residues 22-241 via a 37-residue linker, cloned into pAcGP67A vector (BD Biosciences) and produced in Sf9 cells. The protein was purified using Protein A and size exclusion chromatography. The meditope-Fc included a polypeptide having an amino acid sequence as set forth in SEQ ID NO: 57 (shown below with a leader ("G") in position 1, meditope bolded, linker italicized, Fc portion in plain text):

```
                                          (SEQ ID NO: 57)
GCQFDLSTRRLRCGGSRSGGTSGGGSVPGSGSSGSTSGSGKSSEGSGQA

STHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEY

KCKVSNKALPAPIEKTISKAKGQPREPQVYTLPPSRDELTKNQVSLTCL

VKGFYPSDIAVEWESNGQPENNYKTTPPVLDSDGSFFLYSKLTVDKSRW

QQGNVFSCSVMHEALHNHYTQKSLSLSPGK.
```

Using this construct, it was demonstrated by size exclusion chromatography (SEC) that cetuximab Fab, EGFRdIII and meditope form a complex. The meditope-Fc construct was added to a stoichiometric complex of EGFRdIII and cetuximab Fab and observed a new peak, which eluted much earlier than the Fab-EGFRdIII complex, consistent with an increase in the hydrodynamic mass. SDS-PAGE of this new peak showed the presence of all three proteins. These studies further confirmed that the meditope did not significantly interfere with antigen recognition.

Example 2 Generation of a Meditope-Enabled Trastuzumab

A meditope binding site was grafted onto a human mAb framework to generate a meditope-enabled antibody (meditope enabled antibody), specifically, a meditope enabled antibody trastuzumab. The sequences of cetuximab and trastuzumab were aligned and sequence identity mapped onto the atomic model of trastuzumab (1N8Z, see Cho et al., Nature 421, 756-760(2003)). Based on this mapping and the superposition of cQFD-cetuximab and trastuzumab structures, thirteen (13) residues were identified that differ between cetuximab and trastuzumab and whose side chains either make direct contact with the meditope or may indirectly affect meditope binding. These residues were: Thr40, Asn41, Asp85 in the light chain (see above), Arg39, and Arg45 in the light chain, which coordinate a non-bonded phosphate group and in some examples stabilize the loop containing Thr40 and Asn41 in the light chain, Val9 and Ile10 which participate in forming a shallow hydrophobic surface near the side chain of Leu10 in the meditope, and Gly42, Ser43, Ile83 and Ala100 of the light chain, as well as Ser40 and Ile89 in the heavy chain. The light chain sequence of this meditope enabled antidoy is set forth in SEQ ID NO: 303 and the heavy chain is shown in SEQ ID NO: 304 (without the meditope peptide sequence and the linker sequence).

Equivalent positions in the trastuzumab sequence were mutated (to Thr40, Asn41, Asp85, Arg39, Arg45, Ile9, Leu10, Gly42, Ser43, Ile83 and Ala100 in the light chain and Ser40 and Ile89 in the heavy chain, based on Kabat numbering), and the protein produced and purified. Using SPR, it was shown that the cQFD meditope bound to the grafted trastuzumab Fab with similar affinity as cetuximab ($K_D$=1.2 µM). It was also observed that the meditope-enabled trastuzumab Fab bound to soluble HER2 with similar affinity as the Fab isolated from the commercial source, confirming that the mutations had no deleterious effect on antigen binding. It was demonstrated by size exclusion chromatography that the meditope-enabled trastuzumab, sHER2, and meditope-Fc co-eluted.

To further confirm that the point mutations did not significantly perturb the overall structure of the Fab, the Fab of the trastuzumab meditope enabled antibody was crystallized with and without the cQFD meditope. Well diffracting crystals were obtained in the presence of Protein A and Protein L to aid crystallization. The structures of the apo-meditope enabled antibody trastuzumab and the meditope-containing complex were solved at 1.95 and 2.0 Å, respectively. The parental trastuzumab Fab bound to Protein A and Protein L was also crystallized and solved to 2.08 Å resolution. Superposition of either the apo-parental trastuzumab Fab or HER2-bound parental trastuzumab Fab (22) onto "apo"-meditope enabled antibody trastuzumab revealed only minor changes in the overall structure (RMSD=0.22 Å and 0.56 Å over 433 and 431 Cα atoms, respectively). Superposition of the "apo"- and meditope-liganded meditope enabled antibody trastuzumab showed that meditope occupancy stabilized the heavy chain loop (residues 39-44) in an open conformation, similar to what was observed for cetuximab, and accounted in part for the slightly higher RMSD. More importantly, residues (Thr40, Asn41 and Asp85) identified by the sequence mapping in the "apo"- and meditope-liganded meditope enabled antibody were essentially in the same positions as their counterparts in cetuximab, and formed similar interactions with the meditope. Important side chain rotamers of the meditope were also essentially the same as they were in the cQFD-cetuximab structure. As with cetuximab, significant alterations in the CDR loops were not observed.

These data demonstrate successful grafting of a meditope binding site onto a human Fab framework without significantly affecting antigen binding. The successful grafting of the meditope site further validates the initial cetuximab-meditope model obtained through diffraction data and the specificity of the interaction. The data further confirm the feasibility of enhancing meditope binding affinity through avidity, and show that a bivalent meditope is specific and binds with high affinity, but only in the presence of the cognate meditope enabled antibody, to cells overexpressing the antigen.

Example 3 Increasing Antibody Internalization Using Meditope Fusion Antibody Crosslinking SnAP-bodies (meditope enabled antibodies including a meditope fused to the N-terminus of the heavy chain via a linker) were assessed for their ability to be internalized by cells expressing a target antigen.

A. Antibody Production

Three different antibodies were produced in a mammalian expression system. Each antibody included a meditope-enabled gemtuzumab light chain including the amino acid sequence of SEQ ID NO: 254. SnAP-body variant 1 had a heavy chain including a meditope-enabled gemtuzumab IgG1 heavy chain sequence fused to a meditope via a linker (SEQ ID NO: 255). SnAP-body variant 2 had a heavy chain including a meditope-enabled gemtuzumab IgG1 heavy chain sequence fused to a meditope via a linker (SEQ ID NO: 256). The control antibody had a meditope-enabled gemtuzumab IgG1 heavy chain amino acid sequence (SEQ ID NO: 257), but without a meditope or a linker fused to its N-terminus.

Nucleic acids encoding SEQ ID NOS: 254-257 were cloned into CMV-based pCEP4 expression vectors containing an EBV origin of replication (Invitrogen). The expression vectors were transfected into a human embryonic kidney 293 cell line (HEK-293) comprising the Epstein-Barr virus (EBV) at 1 μg endotoxin-free DNA/$10^6$ cells using a polyethylenimines transfection reagent (FuGENE® HD, Promega). The cells were cultured for six to seven days in FREESTYLE™ 293 expression media (Invitrogen, Carlsbad, Calif.) supplemented with 25 μg/ml Hygromycin B (Thermo Fischer Scientific) and 0.1% Pluronic® F68 (Thermo Fischer Scientific). The cell culture supernatant was then sterilized using a 0.22 μM filter and stored at 4° C. until purification.

Antibodies were purified with a protein A column followed by a size exclusion chromatography (SEC) column, yielding 95% purity and endotoxin levels ≤1 EU/mg. The antibodies were formulated in a sterile buffer containing 20 mM histidine and 5% sucrose at a final concentration of 5 mg/ml. Concentration was determined by spectrophotometry (Nanodrop 2000c; Thermo Fisher). Production of intact antibody was confirmed by visualization on a standard protein gel.

B. Antibody Labeling

SnAP-body variant 1, SnAP-body variant 2, and the control antibody were labeled with pHrodo™ Red SE (Thermo Fisher Scientific, Waltham, Mass.) according to manufacturer's instructions. The pHrodo™ dye is pH sensitive; its fluorescence increases as pH decreases. Thus, quantifying the fluorescence of pHrodo™-labeled antibodies indicates the rates of antibody endocytosis. Briefly, pHrodo™ was prepared in dry dimethyl sulfoxide (DMSO) (Invitrogen) to achieve a final concentration of 2-5 μM of dye. 2 mg of antibody was dissolved in 2 mL of phosphate buffered saline (PBS) at pH 9. pHrodo™ dye was then added slowly in four 50 ul increments to the antibody solution and incubated with each addition for 15 minutes with rocking at room temperature.

C. Fluorescence Microscopy

HL-60 cells expressing CD33 were incubated on ice prior to the addition of antibody. Cells were stained for fluorescence microscopy with pHrodo™-labeled SnAP-body variant 1, SnAP-body variant 2, or control antibody to determine receptor-mediated antibody endocytosis rates. Labeled cells were incubated for 15 minutes in a 37° C. water bath. Cells were washed with ice-cold buffer (PBS supplemented with 1% BSA), resuspended in 100 μl buffer, and fixed by adding 100 μl of 4% paraformaldehyde. Cells were then added to Nunc® Lab-Tek® II chambered slide systems with 8 wells per slide (0.7 cm2/well) for imaging. Slides were subsequently mounted in Fluoromount G (Southern Biotechnology, Birmingham, Ala.).

Figure 7B:
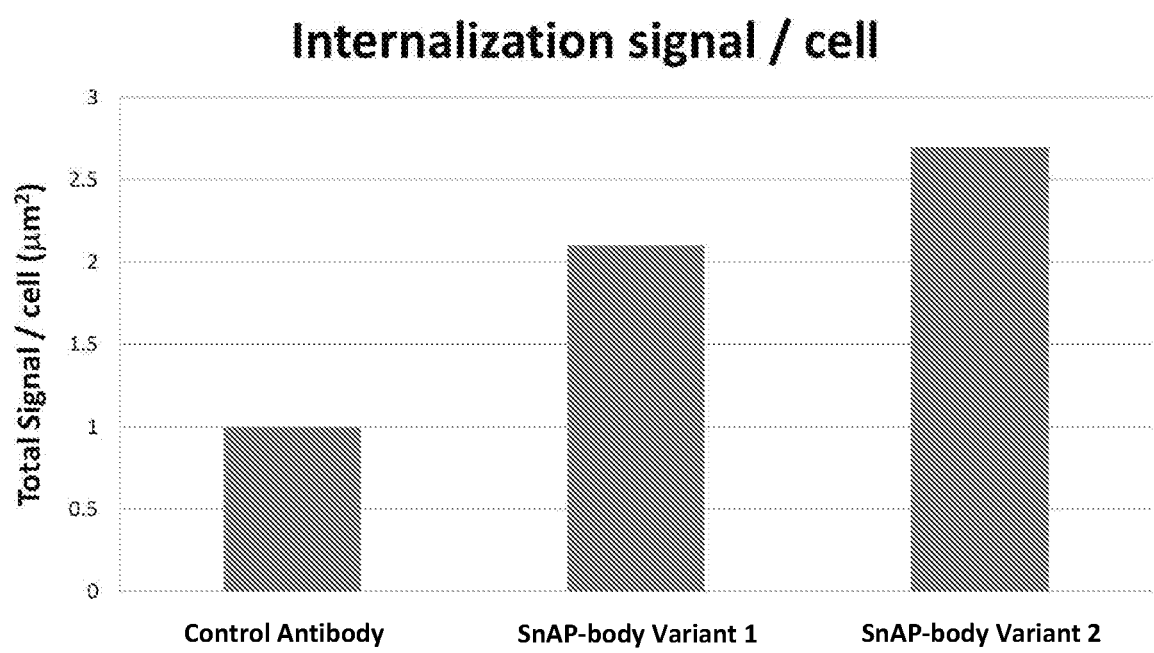
FIG. 7B shows the average amount antibody internalization as calculated by the amount of fluorescence detected in each cell stained with pHrodo™-labeled SnAP-body variant 1, SnAP-body variant 2, or control antibody and imaged using a confocal microscope. Higher values indicate increased receptor-mediated antibody endocytosis rates.

Cells were imaged with a confocal microscope using appropriate wavelength settings for pHrodo™-labeled antibodies, as shown in FIG. 7A. Z sectioning permitted visualization of the internalized materials and all quantitative measurements were taken at the same defined section height. More than 30 cells were visualized and quantified at each time point with three focal fields for each visualization event. Fluorescence for each imaged cell was calculated using ImageJ, averaged for each condition, and normalized to the control. Total staining for SnAP-body variant 1 was more than 2.5 times greater than the control. Total staining for SnAP-body variant 2 was more than 2.0 times greater than the control, as shown in FIG. 7B. The results indicate that HL-60 cells internalize self-crosslinking SnAP-bodies at more than twice the rate of the non-crosslinking control antibody.

Example 4 Increasing Antibody Internalization Using Meditope Fusion Antibody Crosslinking HL-60 cells expressing CD33 were incubated on ice prior to the addition of antibody. Cells were stained for flow cytometric analysis with pHrodo™-labeled SnAP-body variant 1, SnAP-body variant 2, or control antibody, as described in Example 1, to determine receptor-mediated antibody endocytosis rates. Labeled cells were incubated for 15 minutes in a 37° C. water bath. Cells were washed with ice-cold buffer (PBS supplemented with 1% BSA), resuspended in 100 μl buffer.

Figure 8:
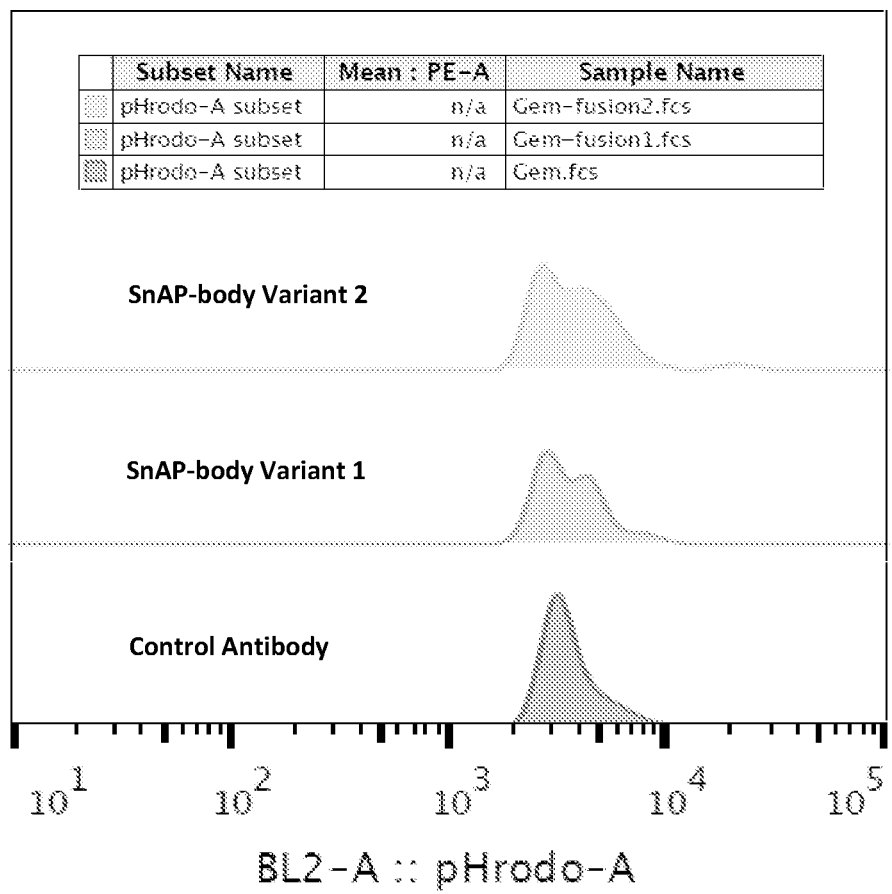
FIG. 8 shows histogram plots of CD33 expressing cells stained with pHrodo™-labeled SnAP-body variant 1, SnAP-body variant 2, or control antibody. Higher values and peaks indicate increased receptor-mediated antibody endocytosis rates.

Cells were analyzed using a CytoFLEX flow cytometer (Becton Dickinson) and analyzed in a histogram using FloJo, version 9. The data for the self-crosslinking antibodies (SnAP-body variants 1 and 2) show additional peaks with increased intensity as compared to the control, indicating that the HL-60 cells internalize the self-crosslinking antibodies at an increased rate as compared to the control (FIG. 8).

Example 5 Increasing Antibody Crosslinking Using Meditope-Antibody Fusions

Four different antibodies were produced in a mammalian expression system. Each antibody included a meditope-enabled gemtuzumab light chain including the amino acid sequence of SEQ ID NO: 254. SnAP-body variant 1 and 2 were produced as described in Example 1. SnAP-body variant 3 had a heavy chain including a meditope-enabled gemtuzumab IgG1 heavy chain sequence fused to a meditope via a linker (SEQ ID NO: 279). The control antibody had a meditope-enabled gemtuzumab IgG1 heavy chain amino acid sequence (SEQ ID NO: 257), but without a meditope or a linker fused to its N-terminus. Sequences were clones into expression vectors and expressed as described in Example 1.

Antibodies were then purified and analyzed by size-exclusion chromatography using SRT-10C SEC columns from Sepax technologies. The columns contained 5-10 μm silica particles coated with hydrophilic and neutral nanometer-thick films. The particles also contained 100 Å pores. Columns were first equilibrated with histidine-sucrose buffer (histidine 20 mM pH6, sucrose 5%). The sample was loaded and eluted at 1 ml/min in the same buffer. The chromatogram was recorded with an UV detector set at 280 nM.

Figure 9A:
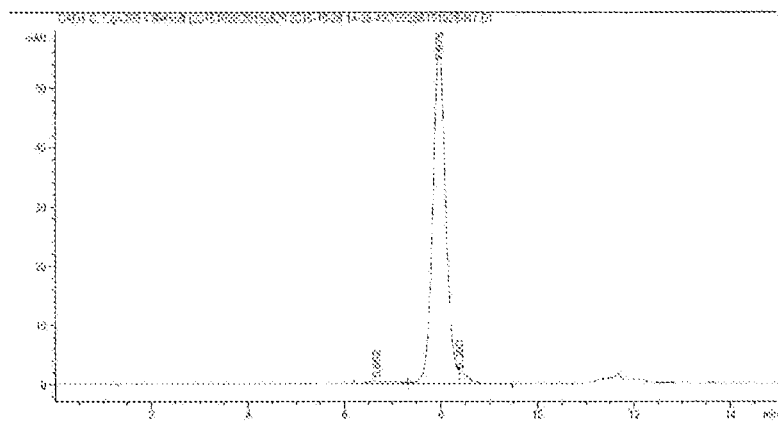
FIGS. 9A-9D show size exclusion chromatographs of self-crosslinking antibody monomers, dimers, and trimers.
Figure 9B:
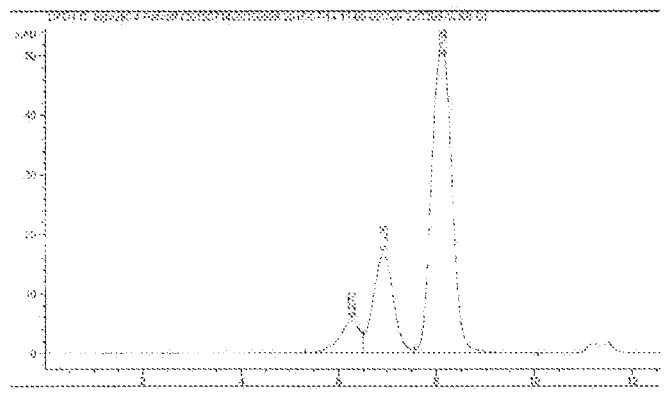
Figure 9C:
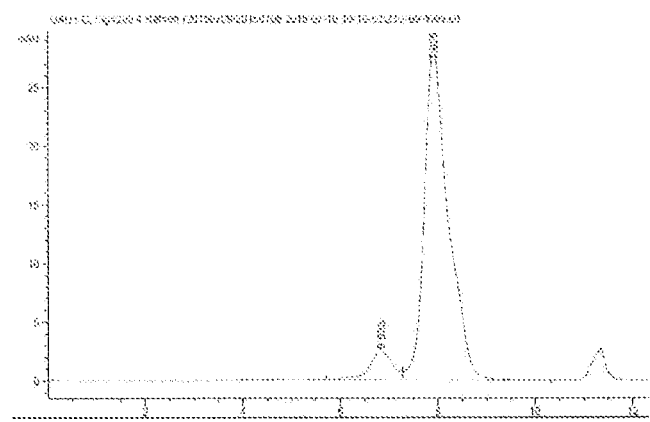
Figure 9D:
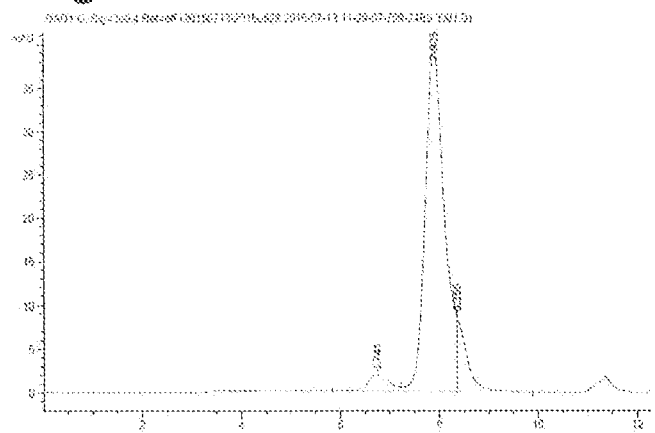

The data show that the gemtuzumab control antibody eluted as a single monomeric peak (FIG. 9A), whereas the self-crosslinking SnAP-body variants 1, 2, and 3 were able to form dimers and multimers, as evidenced by the smaller early peaks (FIGS. 9B-9D, respectively).

Example 6 Antibody Self-Crosslinking can be Concentration Dependent

SnAP-body variant 1, SnAP-body variant 2, and the control gemtuzumab antibody from Example 1 were each prepared as 1 nM and 100 nM samples in a phosphate buffered saline solution. The PBS contained 137 nM of NaCl, 2.7 mM of KCl, 10 mM of $Na_2HPO_4$, and 1.8 mM of $KH_2PO_4$. Each sample was them mixed with an equal volume of 2× sample buffer made of 62.5 mM Tris-HCl, pH 6.8, 25% glycerol, and 1% Bromophenol Blue. The samples were then loaded into a polyacrylamide gel β-12% polyacrylamide gradient NativePAGE® Bis-Tris Gels (Thermo Fisher)) in a gel electrophoresis chamber containing running buffer (50 mM BisTris, 50 mM Tricine, pH 6.8). The gels were run at a constant 150 V for 90-115 minutes. Gels were then stained with a Pierce silver staining kit from Thermo Scientific (cat #24612) according to the manufacturer's instructions.

Figure 10:
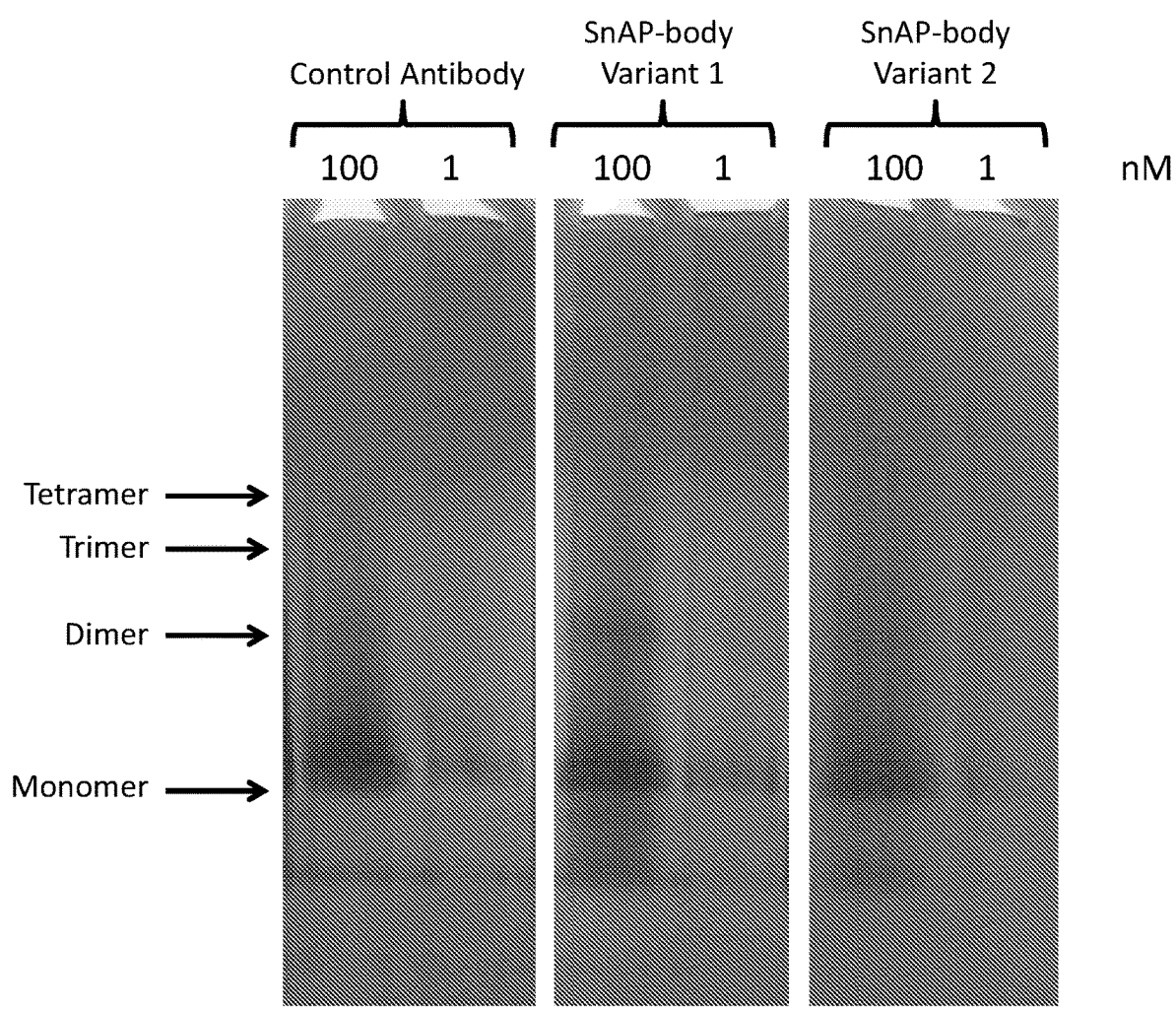
FIG. 10 shows self-crosslinking antibody monomers, dimers, trimers, and tetramers as depicted in a silver-stained native electrophoresis gel. A control antibody, SnAP-body variant 1, and SnAP-body variant 2 were run at both 100 nM and 1 nM concentrations.

The results showed that self-crosslinking antibodies formed multimers, including dimers, trimers, and tetramers, in a concentration-dependent manner (FIG. 10). The control gemtuzumab antibody only formed monomers, and did not self-crosslink.

Example 7 Antibody Self-Crosslinking can be Modulated by Free-Meditope Peptide SnAP-body variant 1, SnAP-body variant 2, SnAP-body variant 3, and the control gemtuzumab antibody from Examples 1 and 3 were each prepared in duplicate as 100 nM samples in a phosphate buffered saline solution. Free meditope (cQFD, SEQ ID NO: 1) was then added to one of the samples at a final concentration of 1 µM and incubated for 30 minutes. Each sample was them mixed with an equal volume of 2× sample buffer made of 62.5 mM Tris-HCl, pH 6.8, 25% glycerol, and 1% Bromophenol Blue. The samples were then loaded into a polyacrylamide gel β-12% polyacrylamide gradient NativePAGE® Bis-Tris Gels (Thermo Fisher)) in a gel electrophoresis chamber containing running buffer (50 mM BisTris, 50 mM Tricine, pH 6.8). The gels were run at a constant 150 V for 90-115 minutes. Gels were then stained with a Pierce silver staining kit from Thermo Scientific (cat #24612) according to the manufacturer's instructions.

Figure 11:
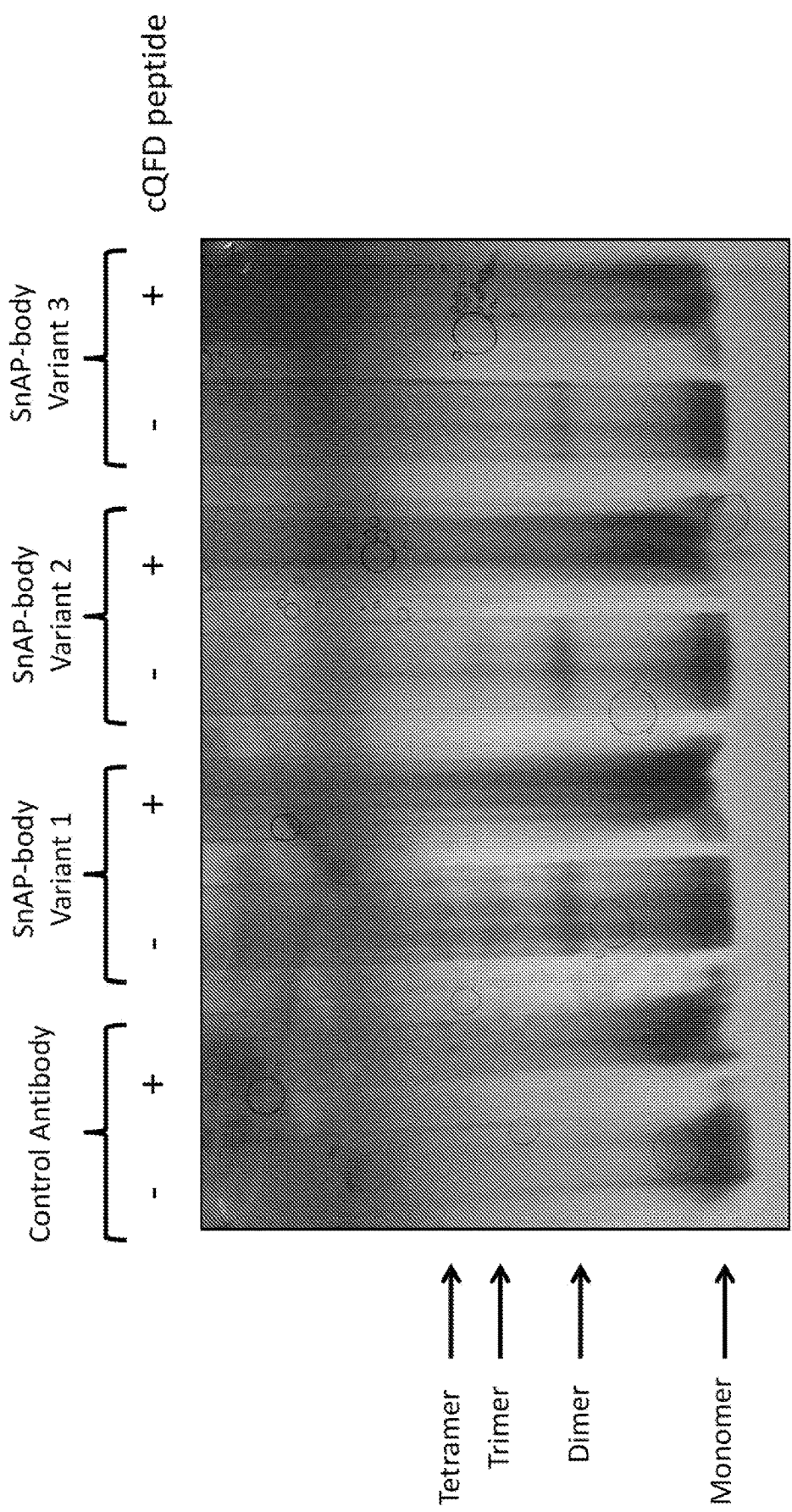
FIG. 11 shows self-crosslinking antibody monomers, dimers, trimers, and tetramers as depicted in a silver-stained native electrophoresis gel. A control antibody, SnAP-body variant 1, SnAP-body variant 2, and SnAP-body variant 3 were run at both 100 nM with and without the addition of 1 µM cQFD meditope peptide (SEQ ID NO: 1). The results show that self-crosslinking can be modulated by meditope peptide.

The results show that free meditope can interfere with the self-crosslinking ability of self-crosslinking antibodies. SnAP-body variants 1, 2, and 3 each exhibited the ability to form dimers, trimers, and tetramers in the absence of free meditope (FIG. 11). However, there were little to no detectable multimers when an excess of free meditope was added.

Example 8 Efficacy of SnAP-Bodies in an Ovarian Xenograft Model in Nude Mice This study was performed to evaluate the efficacy of ADC constructs against HER2 expressing SK-OV-3-Luc ovarian xenograft subcutaneous model using both bioluminescent imaging and traditional tumor caliper measurement. Sixty-five female athymic nudes, 4 weeks old of age were obtained from Charles River. SK-OV-3-Luc cells were expanded using standard tissue culture technique. On the day of implantation, $2.5 \times 10^6$ cells in incomplete media with 30% matrigel were implanted to the right lower flank of each mouse. Animals were stratified into 7 groups of 8 mice for treatment based on the total flux (Perkin Elmer IVIS Lumina XRMS II) at day 10 pi. Animals were weighed twice weekly in conjunction with tumor measurements. Bioluminescent Imaging were performed once a week. Tumor mass were calculated using the following formula:

Mass (mg)=Tumor volume $(mm^3)=d^2 \times D/2$, where $d$ and $D$ are the shortest and longest diameter in mm, respectively.

Animals were treated according to the following table (BIW: twice a week; QW: once a week, DM1: Mertansine, MMAD: Monomethyl auristatin D, ADC: antibody-drug conjugate):

| Group | Agent | Dose (mg/kg) | NO. of Mice | Schedule | Route |
| --- | --- | --- | --- | --- | --- |
| 1: Vehicle | Saline | n/a | 8 | BIW × 8 w | ip |
| 2: mAb alone | Trastuzumab (Trast) | 9 | 8 | BIW × 6 w | ip |
| 3: Trast-DM1 | Kadcyla | 3 | 8 | BIW × 8 w | ip |
| 4: MBI Trast-DM1 | MBI HER2 ADC (DM1) | 3 | 8 | BIW × 8 w | ip |
| 5: MBI Snap mAb | MBI HER2 Snapbody (no toxin) | 3 | 8 | BIW × 8 w | ip |
| 6: MBI Trast-MMAD | MBI HER2 ADC (MMAD) | 5 | 8 | BIW × 6 w | ip |
| 7: chemotherapeutic | Paclitaxel | 20 | 8 | BIW × 3 w | ip |

Figure 12:
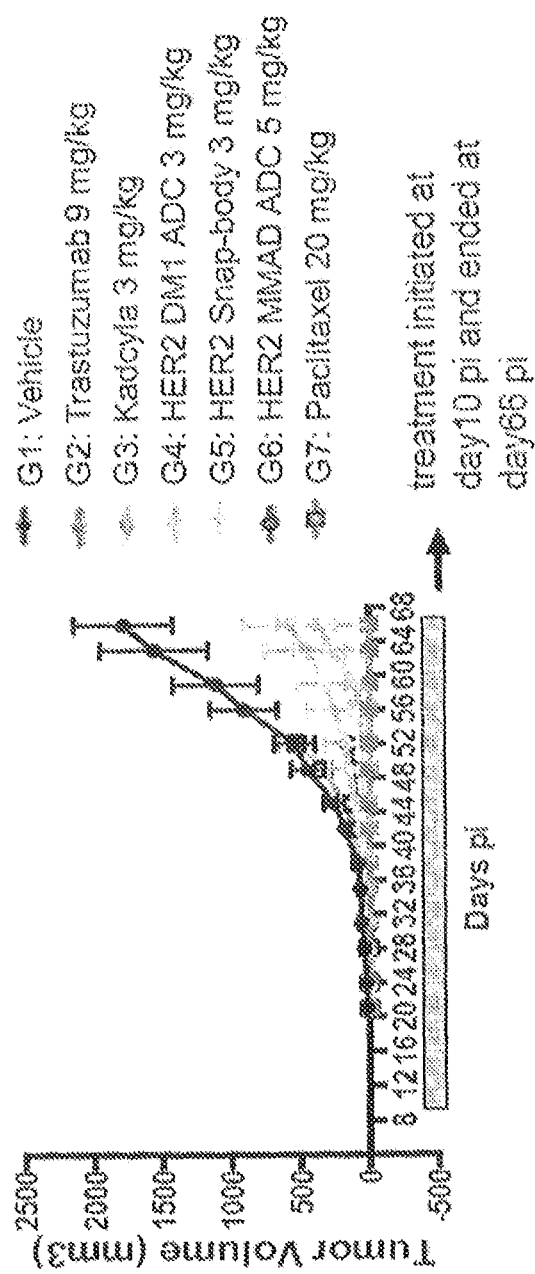
FIG. 12 shows tumor growth reduction in a SK-OV-3-Luc ovarian xenograft mice model treated with SnAP-bodies.

Sequences of the MBI Her2 Snapbody are provided is SEQ ID NOS: 303 and 304. The light chain and heavy chain of MBI Her2 antibody are the same as the Snapbody but but the Her2 antibody does not include the meditope and the linker sequences (see description in Example 2 as well). Results were demonstrated in FIG. 12. Tumors were detectable by bioluminescence at day 10 pi. Tumor volume of the vehicle group kept increasing till the end of the study. When compared to the vehicle group on day 66 pi, HER2 expressing tumors in Group 2 (G2, treated with Trastuzumab at 9 mg/kg) showed complete regression. Kadcyla (trastuzumab conjugated to maytansinoid toxin) showed efficacy at 3 mg/kg. All ADC and Snap-body treatment groups showed tumor growth reduction or repression. Tumor responded to Paclitaxel (20 mg/kg) earlier, but showed minimal (2.80% TGI, day 52 pi) inhibition overall. Most animals showed no adverse effect to each treatment throughout the study and body weight of all groups kept increasing till the end of the study (FIG. 13).

The study demonstrates the efficacy of ADC constructs against HER2 expressing ovarian xenograft subcutaneous model. The individual antibodies and ADC showed expected efficacy. All MBI ADC and Snap-body treatment groups showed tumor growth reduction or repression. Kadcyla (traditional ADC conjugation) and MBI DM1 conjugated ADC showed comparable results as well, demonstrating that the SnAP-body technology retains the activity of the antibodies.

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

SEQUENCE LISTING (306 sequences)

SEQ ID NO: 1 - protein, 12 aa, Artificial Sequence
  Synthetic polypeptide
CQFDLSTRRLKC

SEQ ID NO: 2 - protein, 12 aa, Artificial Sequence
  Synthetic polypeptide
CQYNLSSRALKC

SEQ ID NO: 3 - DNA, 786 bp, Artificial Sequence
  Synthetic sequence
  misc_feature: Synthetic polynucleotide for peptide-Fc fusion protein
tgccagtttgacctgtcaactcggcgactgaaatgcggtgggggctccggttcaggctcgggcggttcatcgggaggagggggaggggaacctaagtcatgcgataagacgcacacctgtcctccatgcccagcccccgagttgcttggtgggccctcagtattcctcttccctccaaaacccaaagacaccttgatgatttcccgcacgccggaagtcacgtgtgtggtcgtggatgtgagccatgaggatcccgaggtgaagttcaattggtacgtggatggagtagaggtacacaacgcgaaaacgaagcccagggaggaacagtacaattccacatatcgcgtggtgtccgtgcttactgtgttgcatcaagactggctgaatgggaaggagtataagtgcaaagtatcaaacaaggcgctgcctgctccaatcgaaaagaccatctcgaaggcgaaaggacaacccagagaaccccaagtctacacgcttccgccctcgcgggatgagctcaccaaaaaccaggtatccctcacttgtttggtaaaaggattctacccgtcggacattgcagtcgagtgggagtcgaatgggcagccggaaaacaactacaaaacaacaccgcccgtcttggactccgatggttcgttctttctctattcgaagctcaccgtagacaagtcgaggtggcagcagggcaacgtcttttcgtgctcagtgatgcatgaggcccttcacaatcactatacgcagaaaagcctgagcctgtcaccggggaagtaa

SEQ ID NO: 4 - protein, 261 aa, Artificial Sequence
  Synthetic polypeptide
CQFDLSTRRLKCGGGSGSGSGGSSGGGGGEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - DNA, 1410 bp, Homo sapiens
atgaaatgctcgtgggtgatctttttccttatggcggtagtaaccggagtaaactccgaggtccagctcgtcgaatccggtggcggcttggtgcagccgggtgggtcgttgcgactgtcgtgcgcagcgtcggggtttaacatcaaagacacctatatccactgggtgaggcaatcgcccggaaaggggctcgaatgggtagccagaatctaccctacgaatggttatactcgatatgcggactccgtgaaaggaagattcaccatcagcgcagatacgtccaaaaacactgcatacctccagatgaatagccttcgggcggaggacacggcgatctactactgtagccggtggggtggggacgggttctatgcgatggactactggggacaggggacgcttgtaacggtcagctcggcgtcaacaaagggacctagcgtgtttcccttggctccctcatcgaaatcaacgtccggtgggacggcggcattggggtgtcttgtcaaggactatttccccgagcccgtgacagtctcgtggaactcgggtgcccttacaagcggcgtacatacgtttcccgccgtgctccaatcatccggactgtattccctttcatccgtcgtgactgtgccgtcctcgtcactcggaacgcaaacttacatttgcaatgtcaaccacaaaccgtcaaatacaaaggtcgataagaaggtcgagccaaagtcgtgtgataagacccacacatgccctccctgtccagcgccggagctgttgggagggccttcagtgttcctcttcccgcccaaacccaaggacaccctgatgattagccgcacacccgaggtgacgtgtgtcgtcgtcgatgtctcacatgaggacccggaggtaaagttcaactggtacgtggatggagtcgaagtgcacaacgcaaaaacaaaacctcgggaagagcagtacaatagcacgtacagagtagtcagcgtgctcaccgtgctgcaccaggattggctcaatggaaaggagtacaagtgtaaagtgtcgaataaggcgctgcctgcccccatcgaaaagacaatttccaaagctaaagggcaaccccgcgagccgcaagtatacaccctcccaccctcgcgcgatgaactgaccaagaaccaggtgtcattgacgtgtctcgtcaagggcttctatccgagcgacattgcagtagaatgggaaagcaacggacagccggaaaacaactacaagactacaccgcctgtccttgattcggatggttccttctttctttactcaaaacttacagtcgacaaatcgaggtggcagcagggaaatgtgttttcgtgcagcgtgatgcacgaggccttgcataatcactatacacagaagtcgttgtcactgtcgccgggaaagtaa

SEQ ID NO: 6 - protein, 184 aa, Homo sapiens
EVQLVESGGGLVQPGGSLRLSCAASGFNIKDTYIHWVRQSPGKGLEWVARIYPTNGYTRYADSVKGRFTISADTSKNTAYLQMNSLRAEDTAIYYCSRWGGDGFYAMDYWGQGTLVTVSSASTKGPSVFPLAPSSKSTSGGTAALGCLVKDYFPEPVTVSWNSGALTSGVHTFPAVLQSSGLYS

SEQ ID NO: 7 - protein, 184 aa, Homo sapiens
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYS

SEQ ID NO: 8 - DNA, 705 bp, Homo sapiens
atggagacagacacgcttttgctttgggtgttgttgttgtgggtccccggttcgacgggggatattcagatgacccagtcaccgatccttctctcggcgagcgtgggggatagagtaacgatcacgtgtagagcgtcccaagacgtcaacacagctgtcgcgtggtatcagcagcggacaaatggatcgccgaggctcctgatctacagcgcatcatttctctattcgggagtcccctcccgattttccggatcgcgcagcggtactgacttcaccctcacgatttcctcccttcaaccggaagatatcgctgattactactgtcagcagcactatacaacacctcccactttcggagcagggacaaaagtggagattaagcgcactgtagcagccccctcggtctttatcttccctcctagcgacgaacaattgaagtcagggaccgcctcggtggtatgcctgcttaacaacttttacccacgggaagccaaagtacagtggaaggtggataatgcgctccagagcggaaactcccaagagagcgtgacagaacaggactcgaaggattcgacgtactcactcagctcaacgctgaccctgtcgaaagcggactatgagaaacacaaggtctacgcgtgcgaggtgacccatcagggcctgagctcccccgtaactaagtcattcaaccggggtgaatgctaa

SEQ ID NO: 9 - protein, 214 aa, Homo sapiens
DIQMTQSPILLSASVGDRVTITCRASQDVNTAVAWYQQRTNGSPRLLIYSASFLYSGVPSRFSGSRSGTDFTLTISSLQPEDIADYYCQQHYTTPPTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10 - protein, 214 aa, Homo sapiens
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11 - DNA, 1440 bp, Homo sapiens
tcactataggggaagcttgccgccaccatgaaatgctcgtgggtgatctttttccttatggcggtagtaaccggagttaactccgaggtccagctcgtcgaatccggtggcggcttggtgcagccgggtgggtcgttgcgactgtcgtgcgcagcgtcggggtttaacatcaaagacacctatatccactgggtgaggcaagcgcccggaaaggggctcgaatgggtagccagaatctaccctacgaatggttatactcgatatgcggactccgtgaaaggaagattcaccatcagcgcagatacgtccaaaaacactgcatacctccagatgaatagccttcgggcggaggacacggcggtctactactgtagccggtggggtggggacgggttctatgcgatggactactggggacaggggacgcttgtaacggtcagctcggctagcacaaagggacctagcgtgtttcccttggctccctcatcgaaatcaacgtccggtgggacggcggcattggggtgtcttgtcaaggactatttccccgagcccgtgacagtctcgtggaactcgggtgcccttacaagcggcgtacatacgtttcccgccgtgctccaatcatccggactgtattccctttcatccgtcgtgactgtgccgtcctcgtcactcggaacgcaaacttacatttgcaatgtcaaccacaaaccgtcaaatacaaaggtcgataagaaggtcgagccaaagtcgtgtgataagacccacacatgccctccctgtccagcgccggagctgttgggagggccttcagtgttcctcttcccgcccaaacccaaggacaccctgatgattagccgcacacccgaggtgacgtgtgtcgtcgtcgatgtctcacatgaggacccggaggtaaagttcaactggtacgtggatggagtcgaagtgcacaacgcaaaaacaaaacctcgggaagagcagtacaatagcacgtacagagtagtcagcgtgctcaccgtgctgcaccaggattggctcaatggaaaggagtacaagtgtaaagtgtcgaataaggcgctgcctgcccccatcgaaaagacaatttccaaagctaaagggcaaccccgcgagccgcaagtatacaccctcccaccctcgcgcgatgaactgaccaagaaccaggtgtcattgacgtgtctcgtcaagggcttctatccgagcgacattgcagtagaatgggaaagcaacggacagccggaaaacaactacaagactacaccgcctgtccttgattcggatggttccttctttctttactcaaaacttacagtcgacaaatcgaggtggcagcagggaaatgtgttttcgtgcagcgtgatgcacgaggccttgcataatcactatacacagaagtcgttgtcactgtcgccgggaaagtaatga

SEQ ID NO: 12 - protein, 477 aa, Homo sapiens
SLGKLAATMKCSWVIFFLMAVVTGVNSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - DNA, 730 bp, Homo sapiens
ataggggaagcttgccgccaccatggagacagacacgcttttgctttgggtgttgttgttgtgggtccccggttcgaccggtgatattcagatgacccagtcaccgtcatccctttcggcgagcgtgggggatagagtaacgatcacgtgtagagcgtcccaagacgtcaacacagctgtcgcgtggtatcagcagaagccaggaaaagcgccgaagctcctgatctacagcgcatcatttctctattcgggagtcccctcccgattttccggatcgcgcagcggtactgacttcaccctcacgatttcctcccttcaaccggaagattttgctacttactactgtcagcagcactatacaacacctcccactttcggacaggggacaaaagtggagattaagcggaccgtagcagccccctcggtctttatcttccctcctagcgacgaacaattgaagtcagggaccgcctcggtggtatgcctgcttaacaacttttacccacgggaagccaaagtacagtggaaggtggataatgcgctccagagcggaaactcccaagagagcgtgacagaacaggactcgaaggattcgacgtactcactcagctcaacgctgaccctgtcgaaagcggactatgagaaacacaaggtctacgcgtgcgaggtgacccatcagggcctgagctcccccgtaactaagtcattcaaccggggtgaatgctaatga

SEQ ID NO: 14 - protein, 240 aa, Homo sapiens
GKLAATMETDTLLLWVLLLWVPGSTGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 12 aa, Artificial Sequence
  Synthetic polypeptide
  misc_feature: Residue at position 2 is D-glutamine
CQFDLSTRRLKC

SEQ ID NO: 16 - protein, 12 aa, Artificial Sequence
  Synthetic polypeptide
CQYDLSTRRLKC

SEQ ID NO: 17 - protein, 12 aa, Artificial Sequence
  Synthetic polypeptide
  VARIANT (3)..(3): Xaa is beta-beta-di-phenyl-Ala
CQXDLSTRRLKC

SEQ ID NO: 18 - protein, 12 aa, Artificial Sequence
  Synthetic polypeptide
  VARIANT (5)..(5): Xaa is beta-beta-di-phenyl-Ala
CQFDXSTRRLKC

SEQ ID NO: 19 - protein, 12 aa, Artificial Sequence
  Synthetic polypeptide
  VARIANT (9)..(9): Xaa is citrulline
CQFDFSTRXLKC

SEQ ID NO: 20 - protein, 12 aa, Artificial Sequence
  Synthetic polypeptide
CQFDFSTRRLKC

SEQ ID NO: 21 - protein, 12 aa, Artificial Sequence
  Synthetic polypeptide
CQFDESTRRLKC

SEQ ID NO: 22 - protein, 12 aa, Artificial Sequence
  Synthetic polypeptide
CQFDYSTRRLKC

SEQ ID NO: 23 - protein, 12 aa, Artificial Sequence
  Synthetic polypeptide
CQFDLSTRRQKC

SEQ ID NO: 24 - protein, 12 aa, Artificial Sequence
  Synthetic polypeptide
CQFDLSTRQLKC

SEQ ID NO: 25 - protein, 12 aa, Artificial Sequence
  Synthetic polypeptide
CQYNLSTARLKC

SEQ ID NO: 26 - protein, 12 aa, Artificial Sequence
  Synthetic polypeptide
CQADLSTRRLKC

SEQ ID NO: 27 - protein, 12 aa, Artificial Sequence
  Synthetic polypeptide
CQFDASTRRLKC

SEQ ID NO: 28 - protein, 12 aa, Artificial Sequence
  Synthetic polypeptide
CQFDLSTARLKC

SEQ ID NO: 29 - protein, 12 aa, Artificial Sequence
  Synthetic polypeptide
CQFDLSTRRAKC

SEQ ID NO: 30 - protein, 12 aa, Artificial Sequence
  Synthetic polypeptide
CQFDLSTRREKC

SEQ ID NO: 31 - protein, 17 aa, Artificial Sequence
  Synthetic polypeptide
  MOD_RES (1)..(1): Acetylation
CQFDLSTRRLRCGGGSK

SEQ ID NO: 32 - protein, 12 aa, Artificial Sequence
  Synthetic polypeptide
GQFDLSTRRLKG

SEQ ID NO: 33 - protein, 12 aa, Artificial Sequence
  Synthetic polypeptide
GQHDLSTRRLKG

SEQ ID NO: 34 - protein, 12 aa, Artificial Sequence
  Synthetic polypeptide
GQNDLSTRRLKG

SEQ ID NO: 35 - protein, 12 aa, Artificial Sequence
  Synthetic polypeptide
GQQDLSTRRLKG

SEQ ID NO: 36 - protein, 12 aa, Artificial Sequence
  Synthetic polypeptide
  VARIANT (3)..(3): Xaa is 2-bromo-L-phenylalanine
GQXDLSTRRLKG

SEQ ID NO: 37 - protein, 12 aa, Artificial Sequence
  Synthetic polypeptide
  VARIANT (3)..(3): Xaa is 3-bromo-L-phenylalanine
GQXDLSTRRLKG

SEQ ID NO: 38 - protein, 12 aa, Artificial Sequence
  Synthetic polypeptide
  VARIANT (3)..(3): Xaa is 4-bromo-L-phenylalanine
GQXDLSTRRLKG

SEQ ID NO: 39 - protein, 12 aa, Artificial Sequence
  Synthetic polypeptide
  VARIANT (9)..(9): Xaa is citrulline
GQFDLSTRXLKG

SEQ ID NO: 40 - protein, 12 aa, Artificial Sequence
  Synthetic polypeptide
  VARIANT (8)..(9): Xaa is citrulline
GQFDLSTXXLKG

SEQ ID NO: 41 - protein, 12 aa, Artificial Sequence
  Synthetic polypeptide
  VARIANT (8)..(8): Xaa is citrulline
GQFDLSTXRLKG

SEQ ID NO: 42 - protein, 11 aa, Artificial Sequence
  Synthetic polypeptide
  VARIANT (11)..(11): Xaa is 7-aminoheptanoic acid
QFDLSTRRLKX

SEQ ID NO: 43 - protein, 12 aa, Artificial Sequence
  Synthetic polypeptide
  VARIANT (1)..(12): Xaa is is beta-alanine
  MOD_RES (12)..(12): bAla
XQFDLSTRRLKX

SEQ ID NO: 44 - protein, 12 aa, Artificial Sequence
  Synthetic polypeptide
  MOD_RES (1)..(1): Dpr
  VARIANT (12)..(12): Xaa is iso-aspartic acid
XQFDLSTRRLKX

SEQ ID NO: 45 - protein, 12 aa, Artificial Sequence
  Synthetic polypeptide
  MOD_RES (1)..(1): bAla
  VARIANT (12)..(12): Xaa is iso-aspartic acid
XQFDLSTRRLKX

SEQ ID NO: 46 - protein, 12 aa, Artificial Sequence
  Synthetic polypeptide
  MOD_RES (1)..(1): Xaa is Dpr
  MOD_RES (12)..(12): Xaa is bAla
XQFDLSTRRLKX

SEQ ID NO: 47 - protein, 9 aa, Artificial Sequence
  Synthetic polypeptide
FDLSTRRLK

SEQ ID NO: 48 - protein, 12 aa, Artificial Sequence
  Synthetic polypeptide
CQFDLSTRRLKC

SEQ ID NO: 49 - protein, 11 aa, Artificial Sequence
  Synthetic polypeptide
  VARIANT (11)..(11): Xaa is 7-aminoheptanoic acid
QYDLSTRRLKX

SEQ ID NO: 50 - protein, 12 aa, Artificial Sequence
  Synthetic polypeptide
  VARIANT (1)..(1): Xaa is beta-azidoalanine
  VARIANT (12)..(12): Xaa is propargylglycine
XQFDLSTRRLKX

SEQ ID NO: 51 - protein, 11 aa, Artificial Sequence
  Synthetic polypeptide
  VARIANT (2)..(2): Xaa is beta-beta-di-phenyl-Ala
  VARIANT (11)..(11): Xaa is 7-aminoheptanoic acid
QXDLSTRRLKX

SEQ ID NO: 52 - protein, 11 aa, Artificial Sequence
  Synthetic polypeptide
  misc_feature: Residue is D-glutamine
  VARIANT (11)..(11): Xaa is 7-aminoheptanoic acid
QFDLSTRRLKX

SEQ ID NO: 53 - protein, 11 aa, Artificial Sequence
  Synthetic polypeptide
  VARIANT (2)..(4): Xaa is beta-beta-di-phenyl-Ala
  VARIANT (11)..(11): Xaa is 7-aminoheptanoic acid
QXDXSTRRLKX

SEQ ID NO: 54 - protein, 11 aa, Artificial Sequence
  Synthetic polypeptide
  MOD_RES (7)..(7): Xaa is n-butyl-arginine
  VARIANT (11)..(11): Xaa is 7-aminoheptanoic acid
QFDLSTXRLKX

SEQ ID NO: 55 - protein, 12 aa, Artificial Sequence
  Synthetic polypeptide
SQFDLSTRRLKS

SEQ ID NO: 56 - DNA, 594 bp, Artificial Sequence
  Synthetic polypeptide
catcatcatcatcatcacagcagcggcctggtgccgcgcggcagccatatggctagcatgtcggactcagaagtcaatcaagaagctaagccagaggtcaagccagaagtcaagcctgagactcacatcaatttaaaggtgtccgatggatcttcagagatcttcttcaagatcaaaaagaccactcctttaagaaggctgatggaagcgttcgctaaaagacagggtaaggaaatggactccttaagattcttgtacgacggtattagaattcaagctgatcagacccctgaagatttggacatggaggataacgatattattgaggctcacagagaacagattggtggatcctgccagtttgatctgagcacccgccgtctgaaatgcggtggcggtggatccgaagttaccatcaaagtcaacctgattttcgcagacggcaaaatccagacggctgaatttaaaggcacgttcgaagaagctacggcggaagcatatcgttacgcggccctgctggcgaaagtgaacggcgaatacacggcagacctggaagacggcggcaatcacatgaacatcaaattcgctggctaa

SEQ ID NO: 57 - protein, 275 aa, Artificial Sequence
  Synthetic polypeptide
GCQFDLSTRRLRCGGSRSGGTSGGGSVPGSGSSGSTSGSGKSSEGSGQASTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 320 aa, Artificial Sequence
  Synthetic polypeptide
  misc_feature: tetravalent-meditope-Fc
GCQFDLSTRRLRCGGSRSGGTSGTGSTSGSGSSGSTSGSGKSSEGSGQASKGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSRSGGTSSSSSGSGSGSSGSTSGSGSSGCQFDLSTRRLRCG

SEQ ID NO: 59 - protein, 210 aa, Artificial Sequence
  Synthetic polypeptide
GPGGSDPGCQFDLSTRRLRCGGSRSGGTSGTGSTSGSGSSGSTSGSGKSSEGSGQASKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSRSGGTSSSSSGSGSGSSGSTSGSGSSGCQFDLSTRRLRCG

SEQ ID NO: 60 - DNA, 726 bp, Artificial Sequence
  Synthetic polypeptide
aagcttgccgccaccatggagacagacacgcttttgctttgggtgttgttgttgtgggtccccggttcgaccggtaccggtgacatcttgttgacgcagtcccccgtcattctgagcgtgtcccccggagagcgggtatcgttttcctgccgagcctcgcaagatatcaacactgcgattgcatggtatcaacagcgcacaaacgggtcgccgagactgctcatctactcagcctcgttcctttatagcggtgtgccttcgaggttctcgggatcacggtcaggaacggattttacactcagcatcaattccgtggaatcagaggacattgcggactactattgtcagcagcactacaccacaccaccgaccttcggcgctgggacgaaagtcgaaatcaagcggaccgtagcagccccctcggtctttatcttccctcctagcgacgaacaattgaagtcagggaccgcctcggtggtatgcctgcttaacaacttttacccacgggaagccaaagtacagtggaaggtggataatgcgctccagagcggaaactcccaagagagcgtgacagaacaggactcgaaggattcgacgtactcactcagctcaacgctgaccctgtcgaaagcggactatgagaaacacaaggtctacgcgtgcgaggtgacccatcagggcctgagctcccccgtaactaagtcattcaaccggggtgaatgctaa

SEQ ID NO: 61 - protein, 241 aa, Artificial Sequence
  Synthetic polypeptide
KLAATMETDTLLLWVLLLWVPGSTGTGDILLTQSPVILSVSPGERVSFSCRASQDINTAIAWYQQRTNGSPRLLIYSASFLYSGVPSRFSGSRSGTDFTLSINSVESEDIADYYCQQHYTTPPTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - DNA, 1425 bp, Artificial Sequence
  Synthetic polypeptide
aagcttgccgccaccatgaaatgctcgtgggtgatctttttccttatggcggtagtaaccggagttaactcccaagtacagcttaagcagtcgggtccggggctggtgcagccatcgcagtcgttgtcaatcacatgcacggtgtcgggattcaacattaaagacacctatatccactgggtccgacaatcccctggtaaagggctggagtggctcggtcggatctaccccacgaacggatacaccaggtataacacgccctttacatcgagactttcaattaacgcggataatagcaagaatcaggtgttcttcaagatgaatagcctccagtcaaatgacactgcaatctactactgtgcccgctggggaggggatggcttttatgcgatggactattgggggcagggaactttggtcacagtaagctccgctagcacaaagggacctagcgtgtttcccttggctccctcatcgaaatcaacgtccggtgggacggcggcattggggtgtcttgtcaaggactatttccccgagcccgtgacagtctcgtggaactcgggtgcccttacaagcggcgtacatacgtttcccgccgtgctccaatcatccggactgtattccctttcatccgtcgtgactgtgccgtcctcgtcactcggaacgcaaacttacatttgcaatgtcaaccacaaaccgtcaaatacaaaggtcgataagaaggtcgagccaaagtcgtgtgataagacccacacatgccctccctgtccagcgccggagctgttgggagggccttcagtgttcctcttcccgcccaaacccaaggacaccctgatgattagccgcacacccgaggtgacgtgtgtcgtcgtcgatgtctcacatgaggacccggaggtaaagttcaactggtacgtggatggagtcgaagtgcacaacgcaaaaacaaaacctcgggaagagcagtacaatagcacgtacagagtagtcagcgtgctcaccgtgctgcaccaggattggctcaatggaaaggagtacaagtgtaaagtgtcgaataaggcgctgcctgcccccatcgaaaagacaatttccaaagctaaagggcaaccccgcgagccgcaagtatacaccctcccaccctcgcgcgatgaactgaccaagaaccaggtgtcattgacgtgtctcgtcaagggcttctatccgagcgacattgcagtagaatgggaaagcaacggacagccggaaaacaactacaagactacaccgcctgtccttgattcggatggttccttctttctttactcaaaacttacagtcgacaaatcgaggtggcagcagggaaatgtgttttcgtgcagcgtgatgcacgaggccttgcataatcactatacacagaagtcgttgtcactgtcgccgggaaagtaa

SEQ ID NO: 63 - protein, 460 aa, Artificial Sequence
  Synthetic polypeptide
KLAATMKCSWVIFFLMAVVTGVNSQVQLKQSGPGLVQPSQSLSITCTVSGFNIKDTYIHWVRQSPGKGLEWLGRIYPTNGYTRYNTPFTSRLSINADNSKNQVFFKMNSLQSNDTAIYYCARWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALH

SEQ ID NO: 64 - protein, 167 aa, Artificial Sequence
  Synthetic polypeptide
GPGGSDPGCQFDLSTRRLRCGGSRSGGTSGTGSTSGSGSSGSTSGSGKSSEGSGQASKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 107 aa, Artificial Sequence
  Synthetic polypeptide
  misc_feature: Moxetumomab light chain variable (VL) region sequence
DIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGCGTKLEIK

SEQ ID NO: 66 - protein, 476 aa, Artificial Sequence
  Synthetic polypeptide
  misc_feature: Moxetumomab heavy chain sequence
MEVQLVESGGGLVKPGGSLKLSCAASGFAFSIYDMSWVRQTPEKCLEWVAYISSGGGTTYYPDTVKGRFTISRDNAKNTLYLQMSSLKSEDTAMYYCARHSGYGTHWGVLFAYWGQGTLVTVSAKASGGPEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAANGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTSLTLAAPEAAGEVERLIGHPLPLRLDAITGPEEEGGRLETILGWPLAERTVVIPSAIPTDPRNVGGDLDPSSIPDKEQAISALPDYASQPGKPPREDLK

SEQ ID NO: 67 - protein, 124 aa, Artificial Sequence
  Synthetic polypeptide
  misc_feature: Moxetumomab heavy chain variable (VH) region sequence
MEVQLVESGGGLVKPGGSLKLSCAASGFAFSIYDMSWVRQTPEKCLEWVAYISSGGGTTYYPDTVKGRFTISRDNAKNTLYLQMSSLKSEDTAMYYCARHSGYGTHWGVLFAYWGQGTLVTVSA

SEQ ID NO: 68 - protein, 238 aa, Artificial Sequence
  Synthetic polypeptide
METDTLLLWVLLLWVPGSTGDIQLTQSPVILSASVGDRVTITCRAGESVDIFGVGFLHWYQQKTNGSPKLLIYRASNLESGVPSRFSGSGSRTDFTLTISSLQPEDIADYYCQQTNEDPYTFGQGTKVEIKRTVAAPSVFIFPPSDEQLKSGAASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 69 - protein, 238 aa, Artificial Sequence
  Synthetic polypeptide
METDTLLLWVLLLWVPGSTGDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKRTVAAPSVFIFPPSDEQLKSGAASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 70 - protein, 451 aa, Artificial Sequence
  Synthetic polypeptide
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 213 aa, Artificial Sequence
  Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGA

SEQ ID NO: 72 - protein, 452 aa, Artificial Sequence
  Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 120 aa, Artificial Sequence
  Synthetic polypeptide
DIQMTQSPILLSASVGDRVTITCRASQDVNTAVAWYQQRTNGSPRLLIYSASFLYSGVPSRFSGSRSGTDFTLTISSLQPEDIADYYCQQHYTTPPTFGAGTKVEIKRTVAAPSVFIFPP

SEQ ID NO: 74 - protein, 120 aa, Artificial Sequence
  Synthetic polypeptide
EVQLVESGGGLVQPGGSLRLSCAASGFNIKDTYIHWVRQSPGKGLEWVARIYPTNGYTRYADSVKGRFTISADTSKNTAYLQMNSLRAEDTAIYYCSRWGGDGFYAMDYWGQGTLVTVSS

SEQ ID NO: 75 - protein, 114 aa, Artificial Sequence
  Synthetic polypeptide
DIQLTQSPVILSASVGDRVTITCRAGESVDIFGVGFLHWYQQKTNGSPKLLIYRASNLESGVPSRFSGSGSRTDFTLTISSLQPEDIADYYCQQTNEDPYTFGQGTKVEIKRTV

SEQ ID NO: 76 - protein, 110 aa, Artificial Sequence
  Synthetic polypeptide
DILLTQSPVILSVSPGERVSFSCRASQDINTAIAWYQQRTNGSPRLLIYSASFLYSGVPSRFSGSRSGTDFTLSINSVESEDIADYYCQQHYTTPPTFGAGTKVEIKRTV

SEQ ID NO: 77 - protein, 120 aa, Artificial Sequence
  Synthetic polypeptide
QVQLKQSGPGLVQPSQSLSITCTVSGFNIKDTYIHWVRQSPGKGLEWLGRIYPTNGYTRYNTPFTSRLSINADNSKNQVFFKMNSLQSNDTAIYYCARWGGDGFYAMDYWGQGTLVTVSS

SEQ ID NO: 78 - protein, 443 aa, Mus musculus
  VARIANT (4)..(165): Xaa can be any naturally occurring amino acid
  misc_feature (176)..(176): Xaa can be any naturally occurring amino acid
  misc_feature (180)..(180): Xaa can be any naturally occurring amino acid
  misc_feature (183)..(183): Xaa can be any naturally occurring amino acid
  misc_feature (216)..(216): Xaa can be any naturally occurring amino acid
  misc_feature (227)..(227): Xaa can be any naturally occurring amino acid
  misc_feature (238)..(238): Xaa can be any naturally occurring amino acid
  misc_feature (247)..(247): Xaa can be any naturally occurring amino acid
  misc_feature (249)..(249): Xaa can be any naturally occurring amino acid
  misc_feature (251)..(251): Xaa can be any naturally occurring amino acid
  misc_feature (262)..(262): Xaa can be any naturally occurring amino acid
  misc_feature (302)..(302): Xaa can be any naturally occurring amino acid
  misc_feature (304)..(304): Xaa can be any naturally occurring amino acid
  misc_feature (310)..(310): Xaa can be any naturally occurring amino acid
  misc_feature (328)..(328): Xaa can be any naturally occurring amino acid
  misc_feature (332)..(332): Xaa can be any naturally occurring amino acid
  misc_feature (347)..(347): Xaa can be any naturally occurring amino acid
  misc_feature (361)..(361): Xaa can be any naturally occurring amino acid
  misc_feature (365)..(365): Xaa can be any naturally occurring amino acid
  misc_feature (373)..(373): Xaa can be any naturally occurring amino acid
  misc_feature (393)..(393): Xaa can be any naturally occurring amino acid
  misc_feature (406)..(406): Xaa can be any naturally occurring amino acid
  misc_feature (424)..(424): Xaa can be any naturally occurring amino acid
  misc_feature (428)..(428): Xaa can be any naturally occurring amino acid
  misc_feature (437)..(437): Xaa can be any naturally occurring amino acid
QVQXQQSGAEXARPGASVKXSCKASGYTFTNYWMQWVKQRPGQGXDWXGAXYPGDGNTRYTQKFKGKATXTADKSSSTAYMQXSSXASEDSAVYYCARGEGNYAWFAYWGQGTXVTVSAAKTTPPSVYPXAPGSAAQTNSMVTXGCXVKGYFPEPVTVTWNSGSXSSGVHTFPAVXQSDXYTXSSSVTVPSSTWPSETVTCNVAHPASSTKVDKKXVPRDCGCKPCXCTVPEVSSVFXFPPKPKDVXTXTXTPKVTCVVVDXSKDDPEVQFSWFVDDVEVHTAQTQPREEQFNSTFRSVSEXPXMHQDWXNGKEFKCRVNSAAFPAPXEKTXSKTKGRPKAPQVYTXPPPKEQMAKDKVSXTCNXTDFFPEDXTVEWQWNGQPAENYKNTQPXMDTDGSYFVYSKXNVQKSNWEAGNTFTCSVXHEGXHNHHTEKSXSHSPGK

SEQ ID NO: 79 - protein, 450 aa, Artificial Sequence
  Synthetic polypeptide
EVQLQQSGAELVKPGASVKLSCTASGFNIKDTYVHWVKQRPEQGLEWIGRIDPANGYTKYDPKFQGKATITADTSSNTAYLQLSSLTSEDTAVYYCVRPLYDYYAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 450 aa, Artificial Sequence; identical to SEQ ID NO: 79
  Synthetic polypeptide

SEQ ID NO: 81 - protein, 451 aa, Homo sapiens
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 451 aa, Homo sapiens
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 442 aa, Mus musculus
EVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSSAKTTPPSVYPLAPGSAAQTNSMVTLGCLVKGYFPEPVTVTWNSGSLSSGVHTFPAVLQSDLYTLSSSVTVPSSPRPSETVTCNVAHPASSTKVDKKIVPRDCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSR

SEQ ID NO: 84 - protein, 442 aa, Mus musculus; identical to SEQ ID NO: 83

SEQ ID NO: 85 - protein, 453 aa, Homo sapiens
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 448 aa, Homo sapiens
QVQLVESGGGVVQPGRSLRLSCAASGFTFSVYGMNWVRQAPGKGLEWVAIIWYDGDNQYYADSVKGRFTISRDNSKNTLYLQMNGLRAEDTAVYYCARDLRTGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 229 aa, Homo sapiens
EVQLVESGGGLVQPGGSLRLSCAASGYVFTDYGMNWVRQAPGKGLEWMGWINTYIGEPIYADSVKGRFTFSLDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCAA

SEQ ID NO: 88 - protein, 449 aa, Homo sapiens [sequence omitted]

SEQ ID NO: 89 - protein, 446 aa, Homo sapiens
QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 448 aa, Homo sapiens
EVQLLESGGGLVQPGGSLRLSCAASGFTFSSYAMSWVRQAPGKGLEWVSGITGSGGSTYYADSVKGRFTISRDNSKNTLYLQMNSLRAEDTAVYYCAKDPGTTVIMSWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 91 - protein, 448 aa, Homo sapiens
  VARIANT (1)..(1): Xaa can be any naturally occurring amino acid
XVQLVQSGAEVKKPGASVKVSCKASGYIFSNYWIQWVRQAPGQGLEWMGEILPGSGSTEYTENFKDRVTMTRDTSTSTVYMELSSLRSEDTAVYYCARYFFGSSPNWYFDVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 92 - protein, 451 aa, Artificial Sequence
  Synthetic polypeptide
EVQLVESGGGLVQPGGSLRLSCAASGYSFTGHWMNWVRQAPGKGLEWVGMIHPSDSETRYNQKFKDRFTISVDKSKNTLYLQMNSLRAEDTAVYYCARGIYFYGTTYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 447 aa, Artificial Sequence
  Synthetic polypeptide
QVQLVQSGAELKKPGSSVKVSCKASGYIFTSSWINWVKQAPGQGLEWIGRIDPSDGEVHYNQDFKDKATLTVDKSTNTAYMELSSLRSEDTAVYYCARGFLPWFADWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - protein, 449 aa, Mus musculus
DVKLVESGGGLVKLGGSLKLSCAASGFTFSNYYMSWVRQTPEKRLELVAAINSDGGITYYLDTVKGRFTISRDNAKNTLYLQMSSLKSEDTALFYCARHRSGYFSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 443 aa, Mus musculus
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSR

SEQ ID NO: 96 - protein, 443 aa, Mus musculus; identical to SEQ ID NO: 95

SEQ ID NO: 97 - protein, 448 aa, Homo sapiens
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 399 aa, Artificial Sequence
  Synthetic polypeptide
QVTLRESGPALVKPTQTLTLTCTVSGFSLTSYSVHWVRQPPGKGLEWLGVIWASGGTDYNSALMSRLSISKDTSRNQVVLTMTNMDPVDTATYYCARDPPSSLLRLDYWGRGTPVTVSSASTKGPSVFPLAPSSKSTSGGTAALGCLVKDYFPEPVTVSWNSGALTSGVHTFPAVLQSSGLYSLSSVVTVPSSSLGTQTYDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 450 aa, Mus musculus
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAKTTAPSVYPLAPVCGGTTGSSVTLGCLVKGYFPEPVTLTWNSGSLSSGVHTFPAVLQSDLYTLSSSVTVTSSTWPSQSITCNVAHPASSTKVDKKIEPRPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 450 aa, Mus musculus; identical to SEQ ID NO: 99

SEQ ID NO: 101 - protein, 450 aa, Artificial Sequence
  Synthetic polypeptide
QVQLVQSGAEVKKPGASVKVSCKASGFNIKDTYIHWVRQAPGQRLEWMGRIDPANGYTKYDPKFQGRVTITADTSASTAYMELSSLRSEDTAVYYCAREGYYGNYGVYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 102 - protein, 452 aa, Artificial Sequence
  Synthetic polypeptide
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 451 aa, Artificial Sequence
  Synthetic polypeptide
EVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 120 aa, Artificial Sequence
  Synthetic polypeptide
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSS

SEQ ID NO: 105 - protein, 435 aa, Artificial Sequence
  Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDERKCCVECPAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 106 - protein, 231 aa, Artificial Sequence
  Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 107 - protein, 451 aa, Artificial Sequence
  Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - protein, 432 aa, Mus musculus
QVQLQQSDAELVKPGASVKISCKASGYTFTDHAIHWAKQKPEQGLEWIGYISPGNDDIKYNEKFKGKATLTADKSSSTAYMQLNSLTSEDSAVYFCKRSYYGHWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSR

SEQ ID NO: 109 - protein, 432 aa, Mus musculus; identical to SEQ ID NO: 108

SEQ ID NO: 110 - protein, 448 aa, Artificial Sequence
  Synthetic polypeptide
  VARIANT (1)..(1): Xaa can be any naturally occurring amino acid
XVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 111 - protein, 447 aa, Mus musculus
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 447 aa, Mus musculus; identical to SEQ ID NO: 111

SEQ ID NO: 113 - protein, 451 aa, Artificial Sequence
  Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - protein, 451 aa, Artificial Sequence; identical to SEQ ID NO: 113
  Synthetic polypeptide

SEQ ID NO: 115 - protein, 449 aa, Homo sapiens
EVQLVQSGAEVKKPGESLKISCKGSGYSFTTYWLGWVRQMPGKGLDWIGIMSPVDSDIRYSPSFQGQVTMSVDKSITTAYLQWNSLKASDTAMYYCARRRPGQGYFDFWGQGTLVTVSSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - protein, 455 aa, Homo sapiens
QVQLVESGGGVVQPGRSLRLSCAASGFTFSTYGMHWVRQAPGKGLEWVAVIWDDGSYKYYGDSVKGRFTISRDNSKNTLYLQMNSLRAEDTAVYYCARDGITMVRGVMKDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 117 - protein, 448 aa, Artificial Sequence
  Synthetic polypeptide
EVQLVESGGGLVQPGGSLRLSCAASGFTFISYAMSWVRQAPGKGLEWVASISSGGNTYYPDSVKGRFTISRDNAKNSLYLQMNSLRAEDTAVYYCARLDGYYFGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEALGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 448 aa, Artificial Sequence
  Synthetic polypeptide
EVQLLESGGGLVQPGGSLRLSCAASGFTFSNYGMSWVRQAPGKGLEWVASIRSGGGRTYYSDNVKGRFTISRDNSKNTLYLQMNSLRAEDTAVYYCVRYDHYSGSSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 119 - protein, 447 aa, Artificial Sequence
  Synthetic polypeptide
QVQLQESGPGLVKPSETLSLTCTVSGYSITGGYLWNWIRQPPGKGLEWIGYISYDGTNNYKPSLKDRVTISRDTSKNQFSLKLSSVTAADTAVYYCARYGRVFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 119 aa, Artificial Sequence
  Synthetic polypeptide
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSS

SEQ ID NO: 121 - protein, 447 aa, Homo sapiens
QVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 122 - protein, 451 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 123 - protein, 448 aa, Homo sapiens
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 124 - protein, 451 aa, Homo sapiens
QVQLQESGPGLVKPSQTLSLTCTVSGGSISSGDYYWSWIRQPPGKGLEWIGYIYYSGSTDYNPSLKSRVTMSVDTSKNQFSLKVNSVTAADTAVYYCARVSIFGVGTFDYWGQGTLVTVSSASTKGPSVLPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 214 aa, Mus musculus
  VARIANT (21)..(117): Xaa is isoleucine or leucine
  misc_feature (125)..(125): Xaa can be any naturally occurring amino acid
  misc_feature (136)..(136): Xaa can be any naturally occurring amino acid
  misc_feature (144)..(144): Xaa can be any naturally occurring amino acid
  misc_feature (150)..(150): Xaa can be any naturally occurring amino acid
  misc_feature (160)..(160): Xaa can be any naturally occurring amino acid
  misc_feature (179)..(179): Xaa can be any naturally occurring amino acid
  misc_feature (181)..(181): Xaa can be any naturally occurring amino acid
  misc_feature (205)..(205): Xaa can be any naturally occurring amino acid
DIQMTQSPASLSASVGETVTXTCRASENXYSYXAWHQQKQGKSPQXXVYNAKTXAGGVSSRFSGSGSGTHFSXKXKSXQPEDFGXYYCQHHYGXFPTFGGGTKXEXKRADAAPTVSXFPPSSEQXTSGGASVVCFXNNFYPKDXNVKWKXDGSERQNGVXNSWTDQDSKDSTYSMSSTXTXTKDEYERHNSYTCEATHKTSTSPXVKSFNRNEC

SEQ ID NO: 126 - protein, 214 aa, Artificial Sequence
  Synthetic polypeptide
DILMTQSPSSMSVSLGDTVSITCHASQGISSNIGWLQQKPGKSFMGLIYYGTNLVDGVPSRFSGSGSGADYSLTISSLDSEDFADYYCVQYAQLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 127 - protein, 214 aa, Artificial Sequence; identical to SEQ ID NO: 126
  Synthetic polypeptide

SEQ ID NO: 128 - protein, 214 aa, Homo sapiens
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 129 - protein, 214 aa, Artificial Sequence
  Synthetic polypeptide
DIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 130 - protein, 213 aa, Mus musculus
QTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 131 - protein, 213 aa, Mus musculus; identical to SEQ ID NO: 130

SEQ ID NO: 132 - protein, 214 aa, Artificial Sequence
  Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - protein, 394 aa, Homo sapiens [sequence omitted]

SEQ ID NO: 134 - protein, 214 aa, Homo sapiens
DIQMTQSPSSLSASVGDRVTITCKASQNVGTNVAWYQQKPGKAPKALIYSASFLYSGVPYRFSGSGSGTDFTLTISSLQPEDFATYYCQQYNIYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 135 - protein, 213 aa, Artificial Sequence; identical to SEQ ID NO: 71
  Synthetic polypeptide

SEQ ID NO: 136 - protein, 215 aa, Artificial Sequence
  Synthetic polypeptide
DIQLTQSPSSLSASVGDRVTMTCSASSSVSSSYLYWYQQKPGKAPKLWIYSTSNLASGVPARFSGSGSGTDFTLTISSLQPEDSASYFCHQWNRYPYTFGGGTRLEIKRTVAAPSVFIFPPSDEQLKSGTASVVCLLNNFYEAKVQWKVDNALQSGNSQESVTEQDSKDSTYSLSSTLTLSPRKADYEKHKVYACEVTHQGLSSPVTKSFNRGEC

SEQ ID NO: 137 - protein, 213 aa, Artificial Sequence
  Synthetic polypeptide
DIQMTQSPSTLSASVGDRVTITCSASSSISYMHWYQQKPGKAPKLLIYTTSNLASGVPARFSGSGSGTEFTLTISSLQPDDFATYYCHQRSTYPLTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 138 - protein, 215 aa, Homo sapiens
EIVLTQSPGTLSLSPGERATLSCRASQSVRGRYLAWYQQKPGQAPRLLIYGASSRATGIPDRFSGSGSGTDFTLTISRLEPEDFAVFYCQQYGSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 139 - protein, 214 aa, Artificial Sequence [sequence omitted]

SEQ ID NO: 140 - protein, 214 aa, Artificial Sequence
  Synthetic polypeptide
DIQMTQSPSSLSASVGDRVTITCRASKTISKYLAWYQQKPGKAPKLLIYSGSTLQSGVPSRFSGSGSGTDFTLTISSLQPEDFATYYCQQHNEYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 141 - protein, 214 aa, Homo sapiens
DIQMTQSPSTLSASVGDRVTITCKASENVDTYVSWYQQKPGKAPKLLIYGASNRYTGVPSRFSGSGSGTDFTLTISSLQPDDFATYYCGQSYNYPFTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - protein, 214 aa, Artificial Sequence
  Synthetic polypeptide
DIVMTQSQRFMSTTVGDRVSITCKASQNVVSAVAWYQQKPGQSPKLLIYSASNRYTGVPDRFTGSGSGTDFTLTISNMQSEDLADFFCQQYSNYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 143 - protein, 209 aa, Mus musculus
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKRADAAPTVFIFPPSDEQLKSGTASVVCLLNNFYPREAKVQWKVDNALQSGNSQESVTEQDSKDSTYSLSSTLTLSKADYEKHKVYACEVTHQGLSSPVTKSFN

SEQ ID NO: 144 - protein, 209 aa, Mus musculus; identical to SEQ ID NO: 143

SEQ ID NO: 145 - protein, 215 aa, Homo sapiens
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 146 - protein, 220 aa, Artificial Sequence
  Synthetic polypeptide
DIVMTQSPDSLAVSLGERATINCKSSQSLLNSGNQKNYLAWYQQKPGQPPKLLIYGASTRESGVPDRFSGSGSGTDFTLTISSLQAEDVAVYYCQNVHSFPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 147 - protein, 213 aa, Mus musculus
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRADTAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 148 - protein, 213 aa, Artificial Sequence
  Synthetic polypeptide
DIQMTQSPSSLSASVGDRVTITCKTSQDINKYMAWYQQTPGKAPRLLIHYTSALQPGIPSRFSGSGSGRDYTFTISSLQPEDIATYYCLQYDNLWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 149 - protein, 214 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 150 - protein, 218 aa, Artificial Sequence
  Synthetic polypeptide
DIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 151 - protein, 214 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 152 - protein, 214 aa, Artificial Sequence
  Synthetic polypeptide
DIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 153 - protein, 213 aa, Artificial Sequence
  Synthetic polypeptide
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 154 - protein, 210 aa, Mus musculus
DIQMTQSPASLSVSVGETVTITCRASENIYSNLAWYQQKQGKSPQLLVYAATNLADGVPSRFSGSGSGTQYSLKINSLQSEDFGSYYCQHFWGTPYTFGGGTRLEIKRADAAPTVFIFPPSDEQLKSGTASVVCLLNNFYPREAKVQWKVDNALQSGNSQESVTEQDSKDSTYSLSSTLTLSKADYEKHKVYACEVTHQGLSSPVTKSFN

SEQ ID NO: 155 - protein, 210 aa, Mus musculus; identical to SEQ ID NO: 154

SEQ ID NO: 156 - protein, 214 aa, Artificial Sequence [sequence omitted]

SEQ ID NO: 157 - protein, 210 aa, Mus musculus
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 158 - protein, 210 aa, Mus musculus; identical to SEQ ID NO: 157

SEQ ID NO: 159 - protein, 214 aa, Artificial Sequence; identical to SEQ ID NO: 10
  Synthetic polypeptide

SEQ ID NO: 160 - protein, 214 aa, Artificial Sequence; identical to SEQ ID NO: 10
  Synthetic polypeptide

SEQ ID NO: 161 - protein, 214 aa, Homo sapiens
DIQMTQSPSSLSASVGDRVTITCRASQGISSWLAWYQQKPEKAPKSLIYAASSLQSGVPSRFSGSGSGTDFTLTISSLQPEDFATYYCQQYNIYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 162 - protein, 214 aa, Homo sapiens
AIQLTQSPSSLSASVGDRVTITCRASQDISSALVWYQQKPGKAPKLLIYDASSLESGVPSRFSGSESGTDFTLTISSLQPEDFATYYCQQFNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 163 - protein, 218 aa, Artificial Sequence
  Synthetic polypeptide
DIQMTQSPSSLSASVGDRVTITCKASESVDNYGKSLMHWYQQKPGKAPKLLIYRASNLESGVPSRFSGSGSGTDFTLTISSLQPEDFATYYCQQSNEDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 164 - protein, 219 aa, Artificial Sequence
  Synthetic polypeptide
DVVMTQSPLSLPVTPGEPASISCKSSQSLLDSDGKTYLNWLLQKPGQSPQRLIYLVSKLDSGVPDRFSGSGSGTDFTLKISRVEAEDVGVYYCWQGTHFPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 165 - protein, 219 aa, Artificial Sequence
  Synthetic polypeptide
DIVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 166 - protein, 111 aa, Artificial Sequence
  Synthetic polypeptide
DIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIK

SEQ ID NO: 167 - protein, 217 aa, Homo sapiens
QSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 168 - protein, 214 aa, Homo sapiens
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 169 - protein, 216 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 170 - protein, 214 aa, Homo sapiens
EIVMTQSPATLSLSPGERATLSCRASQSVSSYLAWYQQKPGQAPRLLIYDASNRATGIPARFSGSGSGTDFTLTISSLEPEDFAVYYCHQYGSTPLTFGGGTKAEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - protein, 221 aa, Homo sapiens
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKS

SEQ ID NO: 172 - protein, 321 aa, Homo sapiens
  misc_feature: CD23 protein sequence
MEEGQYSEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQDLELSWNLNGLQADLSSFKSQELNERNEASDLLERLREEVTKLRMELQVSSGFVCNTCPEKWINFQRKCYYFGKGTKQWVHARYACDDMEGQLVSIHSPEEQDFLTKHASHTGSWIGLRNLDLKGEFIWVDGSHVDYSNWAPGEPTSRSQGEDCVMMRGSGRWNDAFCDRKLGAWVCDRLATCTPPASEGSAESMGPDSRPDPDGRLPTPSAPLHS

SEQ ID NO: 173 - protein, 12 aa, Artificial Sequence
  Synthetic polypeptide
GQFDLSTRRLKG

SEQ ID NO: 174 - protein, 12 aa, Artificial Sequence
  Synthetic polypeptide
GKLRRTSLDFQG

SEQ ID NO: 175 - protein, 847 aa, Homo sapiens
  misc_feature: CD22 protein sequence
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 176 - DNA, 3300 bp, Homo sapiens
  misc_feature: CD22 nucleotide sequence
acttctccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaaaaaaaaa

SEQ ID NO: 177 - protein, 239 aa, Artificial Sequence
  Synthetic polypeptide
  misc_feature: Epratuzumab light chain sequence
MKLPVRLLVLLLFWIPASRGDVQVTQSPSSLSASVGDRVTITCRSSQSLANSYGNTFLSWYLHKPGKAPQLLIYGISNRFSGVPDRFSGSGSGTDFTLTISSLQPEDFATYYCLQGTHQPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 178 - protein, 467 aa, Artificial Sequence
  Synthetic polypeptide
  misc_feature: Epratuzumab heavy chain sequence
MDFGFSLVFLALILKGVQCEVQLVQSGAEVKKPGASVKVSCKASGYRFTNYWIHWVRQAPGQGLEWIGGINPGNNYATYRRKFQGRVTMTADTSTSTVYMELSSLRSEDTAVYYCTREGYGNYGAWFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 179 - protein, 135 aa, Artificial Sequence
  Synthetic polypeptide
  misc_feature: Epratuzumab light chain variable (VL) region sequence
MKLPVRLLVLLLFWIPASRGDVQVTQSPSSLSASVGDRVTITCRSSQSLANSYGNTFLSWYLHKPGKAPQLLIYGISNRFSGVPDRFSGSGSGTDFTLTISSLQPEDFATYYCLQGTHQPYTFGQGTKVEIKRTV

SEQ ID NO: 180 - protein, 12 aa, Artificial Sequence
  Synthetic polypeptide
  MOD_RES (5)..(5): Ala(diphenyl)
CQFDASRRRLKC

SEQ ID NO: 181 - protein, 12 aa, Artificial Sequence
  Synthetic polypeptide
  MOD_RES (3)..(3): Ala(diphenyl)
CQADLSTRRLKC

SEQ ID NO: 182 - protein, 16 aa, Artificial Sequence
  Synthetic polypeptide
CQFDLSTRRLRCGGGS

SEQ ID NO: 183 - protein, 140 aa, Artificial Sequence
  Synthetic polypeptide
  misc_feature: Epratuzumab heavy chain variable (VH) region sequence
MDFGFSLVFLALILKGVQCEVQLVQSGAEVKKPGASVKVSCKASGYRFTNYWIHWVRQAPGQGLEWIGGINPGNNYATYRRKFQGRVTMTADTSTSTVYMELSSLRSEDTAVYYCTREGYGNYGAWFAYWGQGTLVTVSS

SEQ ID NO: 184 - DNA, 1488 bp, Homo sapiens
  misc_feature: CD23 gene sequence
aacggcttcagctagggagcggggagcccaatagagtcagaggccaaatagaacaggaacttggaacaagcagaatttagcataatgaatcctccaagccaggagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccacgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcccacatttgtccccttcttggaaaaaa

SEQ ID NO: 185 - protein, 129 aa, Artificial Sequence
  Synthetic polypeptide
  misc_feature: Lumiliximab light chain variable (VL) region sequence plus leader
MDMRVPAQLLGLLLLWLPGARCDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIK

SEQ ID NO: 186 - protein, 12 aa, Artificial Sequence
  Synthetic sequence
  misc_feature: Synthetic construct
CQFDLSTRRLRC

SEQ ID NO: 187 - protein, 13 aa, Artificial Sequence
  Synthetic sequence
  misc_feature: Synthetic construct
GCQFDLSTRRLRC

SEQ ID NO: 188 - protein, 20 aa, Artificial Sequence
  Synthetic sequence
  misc_feature: Synthetic construct
GPGGSDPGCQFDLSTRRLRC

SEQ ID NO: 189 - protein, 13 aa, Artificial Sequence
  Synthetic sequence
  misc_feature: Synthetic construct
CQFDLSTRRLRCG

SEQ ID NO: 190 - protein, 137 aa, Artificial Sequence
  Synthetic sequence
  misc_feature: Synthetic construct
  misc_feature: Lumiliximab heavy chain variable (VH) region sequence plus leader
MEFGLSWVFLVPLLKGVQCEVQLVESGGGLAKPGGSLRLSCAASGFRFTFNNYYMDWVRQAPGQGLEWVSRISSSGDPTWYADSVKGRFTISRENANNTLFLQMNSLRAEDTAVYYCASLTTGSDSWGQGVLVTVSS

SEQ ID NO: 191 - protein, 279 aa, Homo sapiens
  misc_feature: CD37 protein sequence
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNLISIVGICLGVGLLELGFMTLSIFLCRNLDHVYNRLAYR

SEQ ID NO: 192 - DNA, 1263 bp, Homo sapiens
  misc_feature: CD37 gene sequence
ttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaaaaaaaaaaaaaaaaaaaa

SEQ ID NO: 193 - protein, 107 aa, Artificial Sequence
  Synthetic sequence
  misc_feature: Synthetic construct
  misc_feature: Otlertuzumab light chain variable (VL) region sequence
EIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIK

SEQ ID NO: 194 - protein, 117 aa, Artificial Sequence
  Synthetic sequence
  misc_feature: Synthetic construct
  misc_feature: Otlertuzumab heavy chain variable (VH) region sequence
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSG

SEQ ID NO: 195 - protein, 255 aa, Homo sapiens
  misc_feature: Mucin-1 protein sequence
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 196 - DNA, 768 bp, Homo sapiens
  misc_feature: Mucin-1 gene sequence
atgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtag

SEQ ID NO: 197 - protein, 108 aa, Artificial Sequence
  Synthetic sequence
  misc_feature: Synthetic construct
  misc_feature: hPAM4-Cide light chain variable (VL) region sequence
DIQLTQSPSSLSASVGDRVTMTCSASSSVSSSYLYWYQQKPGKAPKLWIYSTSNLASGVPARFSGSGSGTDFTLTISSLQPEDSASYFCHWNRYPYTFGGGTRLEIKR

SEQ ID NO: 198 - protein, 120 aa, Artificial Sequence
  Synthetic sequence
  misc_feature: Synthetic construct
  misc_feature: hPAM4-Cide heavy chain variable (VH) region sequence
QVQLQQSGAEVKKPGASVKVSCEASGYTFPSYVLHWVKQAPGQGLEWIGYINPYNDGTQYNEKFKGKATLTRDTSINTAYMELSRLRSDDTAVYYCARGFGGSYGFAYWGQGTLVTVSSA

SEQ ID NO: 199 - protein, 37 aa, Artificial Sequence
  Synthetic sequence
  misc_feature: Synthetic construct
GGSRSGGTSGGGSVPGSGSSGSTSGSGKSSEGSGQAS

SEQ ID NO: 200 - protein, 39 aa, Artificial Sequence
  Synthetic sequence
  misc_feature: Synthetic construct
GGSRSGGTSGTGSTSGSGSSGSTSGSGKSSEGSGQASKG

SEQ ID NO: 201 - protein, 30 aa, Artificial Sequence
  Synthetic sequence
  misc_feature: Synthetic construct
GGSRSGGTSSSSSGSGSGSSGSTSGSGSSG

SEQ ID NO: 202 - protein, 36 aa, Artificial Sequence
  Synthetic sequence
  misc_feature: Synthetic construct
GGSRSGGTSGTGSTSGSGSSGSTSGSGKSSEGSGQA

SEQ ID NO: 203 - protein, 30 aa, Artificial Sequence
  Synthetic sequence
  misc_feature: Synthetic construct
GGSRSGGTSGGGSVPGSGSSGSTSGSGKSS

SEQ ID NO: 204 - protein, 30 aa, Artificial Sequence
  Synthetic sequence
  misc_feature: Synthetic construct
GGSRSGGTSGTGSTSGSGSSGSTSGSGKSS

SEQ ID NO: 205 - protein, 111 aa, Artificial Sequence
  Synthetic sequence
  misc_feature: Synthetic construct
SKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 225 aa, Artificial Sequence
  Synthetic sequence
  misc_feature: Synthetic construct
THTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 207 - protein, 14 aa, Artificial Sequence
  Synthetic sequence
  misc_feature: Synthetic construct
GCQFDLSTRRLRCG

SEQ ID NO: 208 - protein, 112 aa, Artificial Sequence
  002-H08 light chain variable (VL) region sequence
  misc_feature: Synthetic construct
QSVLTQPPSASGTPGQRVTISCSGSSSNIGSNDVYWYQQLPGTAPKLLIYDNNKRPSGVPDRFSGSKSGTSASLAISGLRSEDEADYYCQSYDSSLSGSWVFGGGTKLTVLG

SEQ ID NO: 209 - protein, 119 aa, Artificial Sequence
  Synthetic sequence
  misc_feature: Synthetic construct
  misc_feature: 002-H08 heavy chain variable (VH) region sequence
QVELLESGGGLVQPGGSLRLSCAASGFTFDDYGMSWVRQAPGKGLEWVAVISYDGSNKYYADSVKGRFTISRDNSQNTLYLQMNSLRAEDTAVYYCASPLESPVAFDIWGQGTMVIVSS

SEQ ID NO: 210 - protein, 310 aa, Homo sapiens
  misc_feature: SDC-1 protein sequence
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 211 - protein, 108 aa, Artificial Sequence
  Synthetic sequence
  misc_feature: Synthetic construct
  misc_feature: Indatuximab ravtansine light chain variable (VL) region sequence
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKR

SEQ ID NO: 212 - protein, 123 aa, Artificial Sequence
  Synthetic sequence
  misc_feature: Synthetic construct
  misc_feature: Indatuximab ravtansine heavy chain variable (VH) region sequence
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSA

SEQ ID NO: 213 - protein, 1210 aa, Homo sapiens [sequence omitted]

SEQ ID NO: 214 - DNA, 5616 bp, Homo sapiens
  misc_feature: EGFR gene sequence
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctaaaaaaaaaaaaaaaaa

SEQ ID NO: 215 - protein, 109 aa, Artificial Sequence
  Synthetic sequence
  misc_feature: Synthetic construct
  misc_feature: ABT-806 light chain variable (VL) region sequence
DILMTQSPSSMSVSLGDTVSITCHSSQDINSNIGWLQQKPGKSFKGLIYHGTNLDDEVPSRFSGSGSGADYSLTISSLESEDFADYYCVQYAQFPWTFGGGTKLEIKRA

SEQ ID NO: 216 - protein, 116 aa, Artificial Sequence
  Synthetic sequence
  misc_feature: Synthetic construct
  misc_feature: ABT-806 heavy chain variable (VH) region sequence
DVQLQESGPSLVKPSQSLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSA

SEQ ID NO: 217 - protein, 214 aa, Artificial Sequence
  Synthetic sequence
  misc_feature: Synthetic construct
  misc_feature: ABT-806 light chain sequence
DILMTQSPSSMSVSLGDTVSITCHSSQDINSNIGWLQQKPGKSFKGLIYHGTNLDDEVPSRFSGSGSGADYSLTISSLESEDFADYYCVQYAQFPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 218 - protein, 216 aa, Artificial Sequence
  Synthetic sequence
  misc_feature: Synthetic construct
  misc_feature: ABT-806 heavy chain sequence
DVQLQESGPSLVKPSQSLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSAAKTTPPSVYPLAPGCGDTTGSSVTLGCLVKGYFPESVTVTWNSGSLSSSVHTFPALLQSGLYTMSSSVTVPSSTWPSETVTCSVAHPASSTTVDKKLEPS

SEQ ID NO: 219 - protein, 115 aa, Artificial Sequence
  Synthetic sequence
  misc_feature: Synthetic construct
  misc_feature: Zatuximab light chain variable (VL) region sequence
DIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPYTFGGGTKLEIKRTV

SEQ ID NO: 220 - protein, 119 aa, Artificial Sequence
  Synthetic sequence
  misc_feature: Synthetic construct
  misc_feature: Zatuximab heavy chain variable (VH) region sequence
QVQLQQPGAELVEPGGSVKLSCKASGYTFTSHWMHWVKQRPGQGLEWIGEINPSSGRNNYNEKFKSKATLTVDKSSSTAYMQFSSLTSEDSAVYYCVRYYGYDEAMDYWGQGTSVTVSS

SEQ ID NO: 221 - protein, 219 aa, Artificial Sequence
  Synthetic sequence
  misc_feature: Synthetic construct
  misc_feature: Zatuximab light chain sequence
DIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - protein, 447 aa, Artificial Sequence
  Synthetic sequence
  misc_feature: Synthetic construct
  misc_feature: Zatuximab heavy chain sequence
QVQLQQPGAELVEPGGSVKLSCKASGYTFTSHWMHWVKQRPGQGLEWIGEINPSSGRNNYNEKFKSKATLTVDKSSSTAYMQFSSLTSEDSAVYYCVRYYGYDEAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSG

SEQ ID NO: 223 - DNA, 960 bp, Artificial Sequence
  Synthetic sequence
  misc_feature: Synthetic construct
  misc_feature: tetravalent meditope-Fc (M4FC)
gggtgccagttcgacctttccactcgccgcttgaggtgcggtggttcccgtagtggaggtacttctggaacaggcagcacttcgggctccggatcaagcggaagcacatctggttccggaaagtctagcgagggttccggacaagcctccaaggggacacacacgtgtcctccttgtccagctcccgagctgctgggcggaccatctgtatttctgttcccaccaaagcccaaagataccctcatgatttcgcgtacccctgaagtcacatgcgttgtcgtcgatgtgagtcatgaggaccctgaagttaagttcaattggtacgtcgacggagtcgaagtgcataacgctaaaaccaaaccgagagaagaacagtacaacagcacatacagagtggtgagcgtgctcaccgtacttcaccaggactggctgaatggtaaagagtataagtgtaaagttagcaacaaggcgttgcctgctccaatcgagaaaaccatctccaaggcaaagggccaacccagggaaccccaagtatacaccctgcccccgtcgagagatgagttgactaagaaccaagtgagtcttacgtgcttggtgaagggcttctacccatccgacatagcagttgagtgggagtcaaatggccagcccgaaaacaactacaagacaacccctcccgtactggactccgatggatctttcttcctctattcaaagctcacggtcgacaagtctaggtggcagcaaggcaatgtgttcagctgctcagtcatgcacgaggccctgcacaaccactatactcagaagtcactttcgctctccccgggaaaaggtggttcgcgtagtggcggtacgagtagctcaagcagtggttccggtagtggatcttccggttccacctcaggctctggctcatcgggatgtcagtttgatctctcaactaggcgtttgcgctgcggc

SEQ ID NO: 224 - protein, 213 aa, Artificial Sequence
  Synthetic sequence
  misc_feature: Synthetic construct
  misc_feature: MB-004-107 Gemtuzumab enabled antibody, light chain
QIVLTQSPAIMSASPGEKVTITCSASSSISYMHWFQQRTNGSPRLWIYTTSNLASGVPARFSGSGSGTSYSLTISRMEAEDEADYYCHQRSTYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 225 - protein, 446 aa, Artificial Sequence
  Synthetic sequence
  misc_feature: Synthetic construct
  misc_feature: MB-004-107 Gemtuzumab enabled antibody, heavy chain
QVQLQQSGAELAKPGASVKMSCKASGYTFTSYRMHWVKQSPGQGLEWIGYINPSTGYTEYNQKFKDKATLTADKSSSTAYMQLSSLTFEDSAIYYCARGGGVFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 226 - protein, 219 aa, Artificial Sequence
  Synthetic sequence
  misc_feature: Synthetic construct
  misc_feature: MOR-208 Light chain
DIVMTQSPAILSLSPGERATLSCRSSKSLQNVNGNTYLYWFQQKTNGSPRLLIYRMSNLNSGVPDRFSGSGSGTEFTLTISSLEPEDEADYYCIQHLEYPITFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 227 - protein, 451 aa, Artificial Sequence
  Synthetic sequence
  misc_feature: Synthetic construct
  misc_feature: MOR-208 Heavy chain
EVQLVESGGGLVKPGGSLKLSCAASGYTFTSYVMHWVRQSPGKGLEWIGYINPYNDGTKYNEKFQGRVTISSDKSISTAYMELSSLRSEDTAIYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVQFNWYVDGVEVHNAKTKPREEQFNSTFRVVSVLTVVHQDWLNGKEYKCKVSNKALPAPEEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 228 - DNA, 693 bp, Artificial Sequence
  Synthetic sequence
  misc_feature: Synthetic construct
  misc_feature: His6-SMT3-Bivalent meditope (BVM) sequence (Nucleotide)
atgggcagcagccatcatcatcatcatcacagcagcggcctggtgccgcgcggcagccatatgggtggtggttcgtggtcgcatccgcagtttgaaaaaggcggtggttcgggtggtggcatgtcagactcagaagtgaatcaggaagcgaaaccggaagtgaaaccggaagttaaaccggaaacccatattaacctgaaagtcagtgatggcagctctgaaattttctttaaaattaagaaaaccacgccgctgcgtcgcctgatggaagcgtttgccaaacgtcagggcaaagaaatggatagcctgcgtttcctgtatgacggtattcgcatccaggcggatcaaacgccggaagacctggatatggaagataatgacattatcgaagctcatcgtgaacaaatcggtggcggcggttcagccgctccgtcctctgctccgagtccgtctgccccgtgccagtttgacctgtctacccgtcgtctgagttgtggtggtgcgagcccggccgcaagtccgtccgcaccgagcagcccggcgccgaaagccccgagcgcagctccgagttccgccccgtcaccgagcgcgccgggcggctgccagtttgatctgtcaacccgtcgcctgtcgtgtggcggtgcgagcccggccgcaagcccgtctgcgccgtcatcgccggcaccgaaataa

SEQ ID NO: 229 - protein, 230 aa, Artificial Sequence
  Synthetic sequence
  misc_feature: Synthetic construct
  misc_feature: His6-SMT3-Bivalent meditope (BVM) sequence (Amino Acid)
MGSSHHHHHHSSGLVPRGSHMGGGSWSHPQFEKGGGSGGGMSDSEVNQEAKPEVKPEVKPETHINLKVSDGSSEIFFKIKKTTPLRRLMEAFAKRQGKEMDSLRFLYDGIRIQADQTPEDLDMEDNDIIEAHREQIGGGGSAAPSSAPSPSAPCQFDLSTRRLSCGGASPAASPSAPSSPAPKAPSAAPSSAPSPSAPGGCQFDLSTRRLSCGGASPAASPSAPSSPAPK

SEQ ID NO: 230 - DNA, 840 bp, Artificial Sequence
  Synthetic sequence
  misc_feature: Synthetic construct
  misc_feature: His6-SMT-Trivalent meditope (TVM) sequence (Nucleotide)
atgggcagcagccatcatcatcatcatcacagcagcggcctggtgccgcgcggcagccatatgggtggtggttcgtggtcgcatccgcagtttgaaaaaggcggtggttcgggtggtggcatgtcagactcagaagtgaatcaggaagcgaaaccggaagtgaaaccggaagttaaaccggaaacccatattaacctgaaagtcagtgatggcagctctgaaattttctttaaaattaagaaaaccacgccgctgcgtcgcctgatggaagcgtttgccaaacgtcagggcaaagaaatggatagcctgcgtttcctgtatgacggtattcgcatccaggcggatcaaacgccggaagacctggatatggaagataatgacattatcgaagctcatcgtgaacaaatcggtggcggcggttcagccgctccgtcctctgctccgagtccgtctgccccgtgccagtttgacctgtctacccgtcgtctgagttgtggtggtgcgagcccggccgcaagtccgtccgcaccgagcagcccggcgccgaaagccccgagcgcagctccgagttccgccccgtcaccgagcgcgccgggcggctgccagtttgatctgtcaacccgtcgcctgtcgtgtggcggtgcgagcccggccgcaagcccgtctgcgccgtcatcgccggcaccgaaagccccgtccgcagctccgagcagcgcaccgagtccgtccgctccgggcggttgccaattcgacctgtctacgcgtcgcctgagttgtggtggtagcccgtctgccccgtcatcgccgtccagcccgaaactgccggaaaccggttgaggc

SEQ ID NO: 231 - protein, 258 aa, Artificial Sequence
  Synthetic sequence
  misc_feature: Synthetic construct
  misc_feature: His6-SMT-Trivalent meditope (TVM) sequence (Amino Acid)
MGGGSWSHPQFEKGGGSGGGMSDSEVNQEAKPEVKPEVKPETHINLKVSDGSSEIFFKIKKTTPLRRLMEAFAKRQGKEMDSLRFLYDGIRIQADQTPEDLDMEDNDIIEAHREQIGGGGSAAPSSAPSPSAPCQFDLSTRRLSCGGASPAASPSAPSSPAPKAPSAAPSSAPSPSAPGGCQFDLSTRRLSCGGASPAASPSAPSSPAPKAPSAAPSSAPSPSAPGGCQFDLSTRRLSCGGSPSAPSSPSSPKLPETG

SEQ ID NO: 232 - DNA, 474 bp, Artificial Sequence
  Synthetic sequence
  misc_feature: Synthetic construct
  misc_feature: MPL-zHER2 nucleic acid
tgccagttcgatctgtccacccgtcgtctgaaatgcggcggcggcggctcggaagtcacgattaaagtcaacctgatttttgcggatggtaaaattcagaccgccgaatttaaaggcaccttcgaagaagcaacggctgaagcgtatcgttacgcggccctgctggctaaagtgaacggtgaatatacggcggatctggaagacggcggtaaccacatgaatatcaaatttgcagggaattcgggcggtggcagcggtggcagcggttctggcagtggtggctccgggaattcaggcgttgataacaaattcaacaaagaaatgcgcaacgcctattgggaaattgcactgctgccgaatctgaacaatcagcaaaaacgtgcgttcatccgctctctgtacgatgacccgtcccaaagcgcaaatctgctggcggaagcgaaaaaactgaacgacgcacaagccccgaagtaa

SEQ ID NO: 233 - protein, 157 aa, Artificial Sequence
  Synthetic sequence
  misc_feature: Synthetic construct
  misc_feature: MPL-zHER2 amino acid
CQFDLSTRRLKCGGGGSEVTIKVNLIFADGKIQTAEFKGTFEEATAEAYRYAALLAKVNGEYTADLEDGGNHMNIKFAGNSGGGSGGSGSGSGGSGNSGVDNKFNKEMRNAYWEIALLPNLNNQQKRAFIRSLYDDPSQSANLLAEAKKLNDAQAPK

SEQ ID NO: 234 - DNA, 474 bp, Artificial Sequence
  Synthetic sequence
  misc_feature: Synthetic construct
  misc_feature: zIGF1R - MPL nucleic acid
gaggtaaaacatatgaattccgtcgataacaaattcaacaaagagcgttacagcgcatactatgaaatctggcagttgccgaacctgaacgttcgtcagaaagcagcgttcattggtagcctgcaagatgatccgagccaaagcgccaatctgctggctgaggcgaaaaagctgaatgacgcgcaggccccgaagaactcgagcggtagcggtggtggtagcgggaattccggttgccaatttgacttgagcacgcgtcgcctgaagtgtggtggcggtggctctgaggttactattaaggtgaacctgatttttgcagacggtaaaatccagaccgccgagttcaagggcaccttcgaagaagcgacggcagaggcgtatcgctacgcagctctgctggcgaaagtgaatggtgagtataccgcggacctggaagatggcggcaaccacatgaatatcaagtttgcgggctaa

SEQ ID NO: 235 - protein, 157 aa, Artificial Sequence
  Synthetic sequence
  misc_feature: Synthetic construct
  misc_feature: zIGF1R - MPL Amino Acid
EVKHMNSVDNKFNKERYSAYYEIWQLPNLNVRQKAAFIGSLQDDPSQSANLLAEAKKLNDAQAPKNSSGSGGGSGNSGCQFDLSTRRLKCGGGGSEVTIKVNLIFADGKIQTAEFKGTFEEATAEAYRYAALLAKVNGEYTADLEDGGNHMNIKFAG

SEQ ID NO: 236 - protein, 275 aa, Artificial Sequence
  Synthetic sequence
  misc_feature: Synthetic construct
  misc_feature: MFC
GCQFDLSTRRLRCGGSRSGGTSGGGSVPGSGSSGSTSGSGKSSEGSGQDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 237 - protein, 44 aa, Artificial Sequence
  Synthetic sequence
  misc_feature: Synthetic construct
  misc_feature: MB-002-109 bivalent meditope peptide
KPTTIQCQFDLSTRRLKCVRINFKGGYISCQFDLSTRRLKCDIH

SEQ ID NO: 238 - protein, 43 aa, Artificial Sequence
  Synthetic sequence
  misc_feature: Synthetic construct
  misc_feature: MB-002-110 bivalent meditope peptide
KPTTIQCQFDLSTRRLKCRINFKGGYISCQFDLSTRRLKCDIH

SEQ ID NO: 239 - protein, 37 aa, Artificial Sequence
  Synthetic sequence
  misc_feature: Synthetic construct
  misc_feature: MB-002-111 bivalent meditope peptide
TIQCQFDLSTRRLKCVRINKGSCQFDLSTRRLKCDIH

SEQ ID NO: 240 - protein, 7 aa, Artificial Sequence
  Synthetic sequence
  misc_feature: Synthetic construct
FKLMVWY

SEQ ID NO: 241 - protein, 214 aa, Artificial Sequence
  Synthetic sequence
  misc_feature: Synthetic construct
  misc_feature: 83E meditope enabled antibody trastuzumab light chain
DIQMTQSPILLSASVGDRVTITCRASQDVNTAVAWYQQRTNGSPRLLIYSASFLYSGVPSRFSGSRSGTDFTLTISSLQPEDEADYYCQQHYTTPPTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 242 - protein, 120 aa, Artificial Sequence
  Synthetic sequence
  misc_feature: Synthetic construct
  misc_feature: 83E meditope enabled antibody trastuzumab VL sequence
DIQMTQSPILLSASVGDRVTITCRASQDVNTAVAWYQQRTNGSPRLLIYSASFLYSGVPSRFSGSRSGTDFTLTISSLQPEDEADYYCQQHYTTPPTFGAGTKVEIKRTVAAPSVFIFPP

SEQ ID NO: 243 - protein, 109 aa, Artificial Sequence
  Synthetic sequence
  misc_feature: Synthetic construct
  misc_feature: MB-004-107 Gemtuzumab enabled antibody VL
QIVLTQSPAIMSASPGEKVTITCSASSSISYMHWFQQRTNGSPRLWIYTTSNLASGVPARFSGSGSGTSYSLTISRMEAEDEADYYCHQRSTYPLTFGAGTKLELKRTV

SEQ ID NO: 244 - protein, 116 aa, Artificial Sequence
  Synthetic sequence
  misc_feature: Synthetic construct
  misc_feature: MB-004-107 Gemtuzumab enabled antibody VH
QVQLQQSGAELAKPGASVKMSCKASGYTFTSYRMHWVKQSPGQGLEWIGYINPSTGYTEYNQKFKDKATLTADKSSSTAYMQLSSLTFEDSAIYYCARGGGVFDYWGQGTTLTVSS

SEQ ID NO: 245 - protein, 115 aa, Artificial Sequence
  Synthetic sequence
  misc_feature: Synthetic construct
  misc_feature: MOR-208 VL
DIVMTQSPAILSLSPGERATLSCRSSKSLQNVNGNTYLYWFQQKTNGSPRLLIYRMSNLNSGVPDRFSGSGSGTEFTLTISSLEPEDEADYYCIQHLEYPITFGAGTKLEIKRTV

SEQ ID NO: 246 - protein, 121 aa, Artificial Sequence
  Synthetic sequence
  misc_feature: Synthetic construct
  misc_feature: MOR-208 VH
EVQLVESGGGLVKPGGSLKLSCAASGYTFTSYVMHWVRQSPGKGLEWIGYINPYNDGTKYNEKFQGRVTISSDKSISTAYMELSSLRSEDTAIYYCARGTYYYGTRVFDYWGQGTLVTVSS

SEQ ID NO: 247 - protein, 6 aa, Artificial Sequence
  Synthetic sequence
  misc_feature: Synthetic construct
  misc_feature: aldehyde tag
LCTPSR

SEQ ID NO: 248 - protein, 13 aa, Artificial Sequence
  Synthetic sequence
  misc_feature: Synthetic construct
  misc_feature: aldehyde tag
LCTPSRGSLFTGR

SEQ ID NO: 249 - protein, 5 aa, Artificial Sequence
  Synthetic sequence
  misc_feature: Synthetic construct
  misc_feature: sortase sequence
  VARIANT (3)..(3): Xaa is any amino acid
LPXTG

SEQ ID NO: 250 - protein, 274 aa, Artificial Sequence
  Synthetic sequence
  misc_feature: Synthetic construct
CQFDLSTRRLRCGGSRSGGTSGGGSVPGSGSSGSTSGSGKSSEGSGQASTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 251 - protein, 318 aa, Artificial Sequence
  Synthetic sequence
  misc_feature: Synthetic construct
CQFDLSTRRLRCGGSRSGGTSGTGSTSGSGSSGSTSGSGKSSEGSGQASKGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSRSGGTSSSSSGSGSGSSGSTSGSGSSGCQFDLSTRRLRC

SEQ ID NO: 252 - protein, 201 aa, Artificial Sequence
  Synthetic sequence
  misc_feature: Synthetic construct
CQFDLSTRRLRCGGSRSGGTSGTGSTSGSGSSGSTSGSGKSSEGSGQASKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSRSGGTSSSSSGSGSGSSGSTSGSGSSGCQFDLSTRRLRC

SEQ ID NO: 253 - protein, 159 aa, Artificial Sequence
  Synthetic sequence
  misc_feature: Synthetic construct
CQFDLSTRRLRCGGSRSGGTSGTGSTSGSGSSGSTSGSGKSSEGSGQASKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 254 - protein, 213 aa, Artificial Sequence; identical to SEQ ID NO: 224
  Anti-CD33 Light Chain

SEQ ID NO: 255 - protein, 484 aa, Artificial Sequence
  Anti-CD33 SnAP-body variant 1 heavy chain
CQFDLSTRRLKCGGGAREEAAKAAEEAKKAAEEAAKAAQVQLQQSGAELAKPGASVKMSCKASGYTFTSYRMHWVKQSPGQGLEWIGYINPSTGYTEYNQKFKDKATLTADKSSSTAYMQLSSLTFEDSAIYYCARGGGVFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 256 - protein, 476 aa, Artificial Sequence
  Anti-CD33 SnAP-body variant 2 heavy chain
CQFDLSTRRLKCGGGAAARAAAARAAAARAQVQLQQSGAELAKPGASVKMSCKASGYTFTSYRMHWVKQSPGQGLEWIGYINPSTGYTEYNQKFKDKATLTADKSSSTAYMQLSSLTFEDSAIYYCARGGGVFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 257 - protein, 446 aa, Artificial Sequence; identical to SEQ ID NO: 225
  Control anti-CD33 heavy chain

SEQ ID NO: 258 - protein, 106 aa, Artificial Sequence
  Meditope-enabled Gemtuzumab VL
QIVLTQSPAIMSASPGEKVTITCSASSSISYMHWFQQKPGTSPKLWIYTTSNLASGVPARFSGSGSGTSYSLTISRMEAEDAATYYCHQRSTYPLTFGSGTKLELK

SEQ ID NO: 259 - protein, 107 aa, Artificial Sequence
  Meditope-enabled Gemtuzumab VL
DIQMTQSPSTLSASVGDRVTITCRASQSINTWLAWYQQKPGKAPKLLMYKASSLESGVPSRFIGSGSGTEFTLTISSLQPDDFATYYCQQYNSDSKMFGQGTKVEVK

SEQ ID NO: 260 - protein, 116 aa, Artificial Sequence
  Meditope-enabled gemtuzumab VH
QVQLQQSGAELAKPGASVKMSCKASGYTFTSYRMHWVKQRPGQGLEWIGYINPSTGYTEYNQKFKDKATLTADKSSSTAYMQLSSLTFEDSAVYYCARGGGVFDYWGQGTTLTVSS

SEQ ID NO: 261 - protein, 117 aa, Artificial Sequence [sequence omitted]

SEQ ID NO: 262 - protein, 26 aa, Artificial Sequence
  Synthetic linker 1
GGGAREEAAKAAEEAKKAAEEAAKAA

SEQ ID NO: 263 - protein, 18 aa, Artificial Sequence
  Synthetic linker 2
GGGAAARAAAARAAAARA

SEQ ID NO: 264 - protein, 13 aa, Artificial Sequence
  Synthetic linker 3
GGGSKDEIDSAVK

SEQ ID NO: 265 - protein, 3 aa, Artificial Sequence
  Flexible linker portion 1
GGG

SEQ ID NO: 266 - protein, 23 aa, Artificial Sequence
  Rigid linker portion 1
AREEAAKAAEEAKKAAEEAAKAA

SEQ ID NO: 267 - protein, 15 aa, Artificial Sequence
  Rigid linker portion 2
AAARAAAARAAAARA

SEQ ID NO: 268 - protein, 10 aa, Artificial Sequence
  Rigid linker portion 3
SKDEIDSAVK

SEQ ID NO: 269 - protein, 29 aa, Artificial Sequence
  1GCN glucagon
HSQGTFTSDYSKYLDSRRAQDFVQWLMNT

SEQ ID NO: 270 - protein, 38 aa, Artificial Sequence
  Leucine zipper 1C94:A
CGGREGVLKKLRAVENELHYNKSLLEEVKDELQKMRQL

SEQ ID NO: 271 - protein, 37 aa, Artificial Sequence
  Leucine zipper 1C94:A
GGREGVLKKLRAVENELHYNKSLLEEVKDELQKMRQL

SEQ ID NO: 272 - protein, 183 aa, Artificial Sequence
  Four helix bundle 1FHA
MTTASTSQVRQNYHQDSEAAINRQINLELYASYVYLSMSYYFDRDDVALKNFAKYFLHQSHEEREHAEKLMKLQNQRGGRIFLQDIQKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 273 - protein, 153 aa, Artificial Sequence
  Myoglobin 3RGK
GLSDGEWQLVLNVWGKVEADIPGHGQEVLIRLFKGHPETLEKFDRFKHLKSEDEMKASEDLKKHGATVLTALGGILKKKGHHEAEIKPLAQSHATKHKIPVKYLEFISEAIIQVLQSKHPGDFGADAQGAMNKALELFRKDMASNYKELGFQG

SEQ ID NO: 274 - protein, 20 aa, Artificial Sequence
  EK peptide
YAEAAKAAEAAKAAEAAKAF

SEQ ID NO: 275 - protein, 154 aa, Artificial Sequence
  SnAP-body Variant 1 VH
CQFDLSTRRLKCGGGAREEAAKAAEEAKKAAEEAAKAAQVQLQQSGAELAKPGASVKMSCKASGYTFTSYRMHWVKQSPGQGLEWIGYINPSTGYTEYNQKFKDKATLTADKSSSTAYMQLSSLTFEDSAIYYCARGGGVFDYWGQGTTLTVSS

SEQ ID NO: 276 - protein, 213 aa, Artificial Sequence; identical to SEQ ID NO: 224
  Light chain of meditope enabled gemtuzumab

SEQ ID NO: 277 - protein, 484 aa, Artificial Sequence; identical to SEQ ID NO: 255
  cQFD meditope, variant 1 linker, fused to the heavy chain of meditope enabled gemtuzumab

SEQ ID NO: 278 - protein, 476 aa, Artificial Sequence; identical to SEQ ID NO: 256
  cQFD meditope, variant 2 linker, fused to the heavy chain of meditope enabled gemtuzumab

SEQ ID NO: 279 - protein, 471 aa, Artificial Sequence
  cQFD meditope, variant 3 linker, fused to the heavy chain of meditope enabled gemtuzumab
CQFDLSTRRLKCGGGSKDEIDSAVKQVQLQQSGAELAKPGASVKMSCKASGYTFTSYRMHWVKQSPGQGLEWIGYINPSTGYTEYNQKFKDKATLTADKSSSTAYMQLSSLTFEDSAIYYCARGGGVFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 280 - protein, 487 aa, Artificial Sequence
  cQFD meditope, variant 1 linker, fused to the heavy chain of I83E cetuximab
CQFDLSTRRLKCGGGAREEAAKAAEEAKKAAEEAAKAAQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 281 - protein, 214 aa, Artificial Sequence
  Meditope enabled trastuzumab light chain
DIQMTQSPSILSASVGDRVTITCRASQDVNTAVAWYQQRTNKAPRLLIYSASFLYSGVPSRFSGSRSGTDFTLTISSLQPEDEADYYCQQHYTTPPTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 282 - protein, 487 aa, Artificial Sequence
  cQFD meditope, variant 1 linker, fused to the heavy chain of meditope enabled trastuzumab
CQFDLSTRRLKCGGGAREEAAKAAEEAKKAAEEAAKAAEVQLVESGGGLVQPGGSLRLSCAASGFNIKDTYIHWVRQSPGKGLEWVARIYPTNGYTRYADSVKGRFTISADTSKNTAYLQMNSLRAEDTAIYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 283 - protein, 218 aa, Artificial Sequence
  Lintuzumab light chain
DIQMTQSPSSLSASVGDRVTITCRASESVDNYGISFMNWFQQKPGKAPKLLIYAASNQGSGVPSRFSGSGSGTDFTLTISSLQPDDFATYYCQQSKEVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 284 - protein, 446 aa, Artificial Sequence
  Lintuzumab heavy chain
EVQLVQSGAEVKKPGSSVKVSCKASGYTFTDYNMHWVRQAPGQGLEWIGYIYPYNGGTGYNQKFKSKATITADESTNTAYMELSSLRSEDTAVYYCARGRPAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - protein, 218 aa, Artificial Sequence
  Meditope-enabled lintuzumab light chain
DIQMTQSPSILSASVGDRVTITCRASESVDNYGISFMNWFQQRTNKAPRLLIYAASNQGSGVPSRFSGSGSGTDFTLTISSLQPDDEADYYCQQSKEVPWTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 286 - protein, 218 aa, Artificial Sequence
  Meditope-enabled lintuzumab light chain, variant 1
DIQMTQSPSILSASVGDRVTITCRASESVDNYGISFMNWFQQKTNKAPRLLIYAASNQGSGVPSRFSGSGSGTDFTLTISSLQPDDEADYYCQQSKEVPWTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 287 - protein, 218 aa, Artificial Sequence
  Meditope-enabled lintuzumab light chain, variant 2
DIQMTQSPSILSASVGDRVTITCRASESVDNYGISFMNWFQQRTNKAPRLLIYAASNQGSGVPSRFSGSGSGTDFTLTISSLQPDDFATYYCQQSKEVPWTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 288 - protein, 218 aa, Artificial Sequence
  Meditope-enabled lintuzumab light chain, variant 3
DIQMTQSPSILSASVGDRVTITCRASESVDNYGISFMNWFQQRTNGSPRLLIYAASNQGSGVPSRFSGSGSGTDFTLTISSLQPDDIADYYCQQSKEVPWTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 289 - protein, 446 aa, Artificial Sequence
  Meditope-enabled lintuzumab heavy chain
EVQLVQSGAEVKKPGSSVKVSCKASGYTFTDYNMHWVRQSPGQGLEWIGYIYPYNGGTGYNQKFKSKATITADESTNTAYMELSSLRSEDTAIYYCARGRPAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - protein, 484 aa, Artificial Sequence
  Meditope-enabled lintuzumab heavy chain, variant 1
CQFDLSTRRLKCGGGAREEAAKAAEEAKKAAEEAAKAAEVQLVQSGAEVKKPGSSVKVSCKASGYTFTDYNMHWVRQSPGQGLEWIGYIYPYNGGTGYNQKFKSKATITADESTNTAYMELSSLRSEDTAIYYCARGRPAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 476 aa, Artificial Sequence
  Meditope-enabled lintuzumab heavy chain, variant 2
CQFDLSTRRLKCGGGAAARAAAARAAAARAEVQLVQSGAEVKKPGSSVKVSCKASGYTFTDYNMHWVRQSPGQGLEWIGYIYPYNGGTGYNQKFKSKATITADESTNTAYMELSSLRSEDTAIYYCARGRPAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - protein, 471 aa, Artificial Sequence
  Meditope-enabled lintuzumab heavy chain, variant 3
CQFDLSTRRLKCGGGSKDEIDSAVKEVQLVQSGAEVKKPGSSVKVSCKASGYTFTDYNMHWVRQSPGQGLEWIGYIYPYNGGTGYNQKFKSKATITADESTNTAYMELSSLRSEDTAIYYCARGRPAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - protein, 213 aa, Artificial Sequence; identical to SEQ ID NO: 224
  Light chain of CD33-SnAPbody MB-005-101

SEQ ID NO: 294 - protein, 484 aa, Artificial Sequence; identical to SEQ ID NO: 255
  Heavy chain of CD33-SnAPbody MB-005-101. The cQFD meditope (italic and underlined) and variant 1 linker (bold) are fused to the heavy chain of meditope enabled gemtuzumab

SEQ ID NO: 295 - protein, 213 aa, Artificial Sequence; identical to SEQ ID NO: 224
  Light chain of CD33-SnAPbody MB-005-102

SEQ ID NO: 296 - protein, 476 aa, Artificial Sequence; identical to SEQ ID NO: 256
  Heavy chain of CD33-SnAPbody MB-005-102. The cQFD meditope (italic and underlined) and variant 2 linker (bold) are fused to the heavy chain of meditope enabled gemtuzumab

SEQ ID NO: 297 - protein, 213 aa, Artificial Sequence; identical to SEQ ID NO: 224
  Light chain of CD33-SnAPbody MB-005-103

SEQ ID NO: 298 - protein, 471 aa, Artificial Sequence; identical to SEQ ID NO: 279
  Heavy chain of CD33-SnAPbody MB-005-103. The cQFD meditope (italic and underlined) and variant 3 linker (bold) are fused to the heavy chain of meditope enabled gemtuzumab

SEQ ID NO: 299 - protein, 214 aa, Artificial Sequence
  Light chain of EGFR-SnAPbody MB005-104
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 300 - protein, 487 aa, Artificial Sequence; identical to SEQ ID NO: 280
  Heavy chain of EGFR-SnAPbody MB005-104.  The cQFD meditope (italic and underlined) and variant 1 linker (bold) are fused to the heavy chain of cetuximab

SEQ ID NO: 301 - protein, 214 aa, Artificial Sequence
  Light chain of EGFR-SnAPbody MB005-105
DILLTQSPVILSVSPGERVSFSCRASQSIGTNIHWYQQRTNGSPRLLIKYASESISGIPSRFSGSGSGTDFTLSINSVESEDEADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 302 - protein, 487 aa, Artificial Sequence; identical to SEQ ID NO: 280
  Heavy chain of EGFR-SnAPbody MB005-105. The cQFD meditope (italic and underlined) and variant 3 linker (bold) are fused to the heavy chain of I83E cetuximab

SEQ ID NO: 303 - protein, 214 aa, Artificial Sequence; identical to SEQ ID NO: 281
  Light chain of HER2-SnAPbody MB005-106

SEQ ID NO: 304 - protein, 487 aa, Artificial Sequence; identical to SEQ ID NO: 282
  Heavy chain of HER2-SnAPbody MB005-106.  The cQFD meditope (italic and underlined) and variant 3 linker (bold) are fused to the heavy chain of meditope enabled trastuzumab

SEQ ID NO: 305 - protein, 211 aa, Artificial Sequence
  Light chain of CD19-SnAPbody MB005-107
EIVLTQSPVILSASPGERVTITCSASSGVNYMHWYQQRTNGSPKRWIYDTSKLASGVPARFSGSGSGTDYSLTISSMEPEDEADYYCHQRGSYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 306 - protein, 488 aa, Artificial Sequence
  Heavy chain of CD19-SnAPbody MB005-107. The cQFD meditope (italic and underlined) and variant 3 linker (bold) are fused to the heavy chain of meditope enabled anti CD19 antibody
CQFDLSTRRLKCGGGAREEAAKAAEEAKKAAEEAAKAAQVQLVQPGAEVVKPGASVKLSCKTSGYTFTSNWMHWVKQSPGQGLEWIGEIDPSDSYTNYNQNFQGKAKLTVDKSTSTAYMEVSSLRSDDTAIYYCARGSNPYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

The invention claimed is:

1. A recombinant meditope enabled antibody or antigen binding fragment thereof, comprising:
   a) a heavy chain comprising a heavy chain variable (VH) region, a heavy chain constant region (CH) or a portion thereof, wherein the CH or the portion thereof binds a meditope from another meditope enabled antibody, and a light chain comprising a light chain variable (VL) region, a light chain constant region (CL), wherein each chain comprises an amino terminus;
   b) a meditope binding site, wherein the meditope binding site comprises substitutions to amino acid residues within the light chain and within the heavy chain that do not effect antigen binding by the VH and VL;
   c) a linker comprising a carboxy terminus, a rigid, alpha helical segment, a first flexible, unstructured segment, and an amino terminus, wherein the carboxy terminus of the linker is coupled to the amino terminus of the heavy chain or the light chain; and
   d) a cyclic peptide, wherein the cyclic peptide is coupled to the amino terminus of the linker, and wherein the cyclic peptide does not bind to the meditope binding site on the meditope enabled antibody, and
   wherein the meditope comprises an amino acid sequence selected from the group consisting of SEQ ID NO: 1, 2, 15, 16, 17, 18, 19, 20, 21, 22, 23, 24, 25, 26, 27, 28, 29, 30, 31, 32, 34, 35, 36, 37, 38, 39, 40, 41, 42, 43, 44, 45, 46, 47, 48, 49, 50, 51, 52, 53, 54, 55, 186, 187, 188, 189, and 207, or a cyclic peptide derived therefrom.

2. The recombinant meditope enabled antibody or antigen binding fragment thereof of claim 1, wherein the carboxy terminus of the linker and the cyclic peptide are separated by a distance of between 10-120 angstroms.

3. The recombinant meditope enabled antibody or antigen binding fragment of claim 1, wherein the rigid, alpha helical segment of the linker comprises the carboxy terminus of the linker.

* * * * *